US010968255B2

(12) United States Patent
Haynes et al.

(10) Patent No.: US 10,968,255 B2
(45) Date of Patent: Apr. 6, 2021

(54) COMPOSITIONS COMPRISING HIV ENVELOPES TO INDUCE CH235 LINEAGE ANTIBODIES

(71) Applicants: Duke University, Durham, NC (US); Triad National Security, LLC, Los Alamos, NM (US)

(72) Inventors: Barton F. Haynes, Durham, NC (US); Mattia Bonsignori, Durham, NC (US); Hua-Xin Liao, Durham, NC (US); Bette T. Korber, Los Alamos, NM (US); Peter T. Hraber, Los Alamos, NM (US); Kevin Saunders, Durham, NC (US)

(73) Assignees: Duke University, Durham, NC (US); Triad National Security, LLC, Los Alamos, NM (US)

( * ) Notice: Subject to any disclaimer, the term of this patent is extended or adjusted under 35 U.S.C. 154(b) by 0 days.

(21) Appl. No.: 16/081,581

(22) PCT Filed: Mar. 1, 2017

(86) PCT No.: PCT/US2017/020249

§ 371 (c)(1),
(2) Date: Aug. 31, 2018

(87) PCT Pub. No.: WO2017/151801

PCT Pub. Date: Sep. 8, 2017

(65) Prior Publication Data

US 2020/0002383 A1 Jan. 2, 2020

Related U.S. Application Data

(60) Provisional application No. 62/403,503, filed on Oct. 3, 2016, provisional application No. 62/302,017, filed on Mar. 1, 2016.

(51) Int. Cl.

| | |
|---|---|
| ***C07K 14/005*** | (2006.01) |
| ***A61K 39/21*** | (2006.01) |
| ***A61K 39/39*** | (2006.01) |
| ***A61K 45/06*** | (2006.01) |
| ***C12N 7/00*** | (2006.01) |
| *A61K 39/00* | (2006.01) |

(52) U.S. Cl.

CPC ............ *C07K 14/005* (2013.01); *A61K 39/21* (2013.01); *A61K 39/39* (2013.01); *A61K 45/06* (2013.01); *C12N 7/00* (2013.01); *A61K 2039/545* (2013.01); *C12N 2740/16122* (2013.01); *C12N 2740/16134* (2013.01)

(58) Field of Classification Search

CPC .................. C07K 14/005; A61K 39/21; C12N 2740/16122; C12N 2740/16134

See application file for complete search history.

(56) References Cited

U.S. PATENT DOCUMENTS

| | | | |
|---|---|---|---|
| 7,951,377 | B2 | 5/2011 | Korber et al. |
| 8,586,056 | B2 | 11/2013 | Phogat et al. |
| 2011/0171258 | A1 | 7/2011 | Lu et al. |

FOREIGN PATENT DOCUMENTS

| | | | |
|---|---|---|---|
| WO | WO-2013/006688 | A2 | 1/2013 |
| WO | WO-2014/042669 | A1 | 3/2014 |
| WO | WO-2015/127108 | A1 | 8/2015 |
| WO | WO-2015/143193 | A1 | 9/2015 |
| WO | WO-2016/014721 | A2 | 1/2016 |
| WO | WO-2016/049522 | A2 | 3/2016 |
| WO | WO-2017/151801 | | 9/2017 |

OTHER PUBLICATIONS

Alam, S.M., et al., “Role of HIV membrane in neutralization by two broadly neutralizing antibodies,” Proceedings of the National Academy of Sciences of the United States of America, vol. 106, No. 48, pp. 20234-20239 (Dec. 1, 2009).
Alam, S.M., et al., “The Role of Antibody Polyspecificity and Lipid Reactivity in Binding of Broadly Neutralizing Anti-HIV-1 Envelope Human Monoclonal Antibodies 2F5 and 4E10 to Glycoprotein 41 Membrane Proximal Envelope Epitopes,” The Journal of Immunology, vol. 178, pp. 4424-4435 (2007).
Andrabi, R., et al., “Identification of Common Features in Prototype Broadly Neutralizing Antibodies to HIV Envelope V2 Apex to Facilitate Vaccine Design,” Immunity, vol. 43, No. 5, pp. 959-973 (Nov. 17, 2015)—Author Manuscript (25 total pages).
Arnaoty, A., et al., “Reliability of the nanopheres-DNA immunization technology to produce polyclonal antibodies directed against human neogenic proteins,” Molecular Genetics and Genomics, vol. 288, No. 7-8, pp. 347-363 (Jun. 2013).
Arnaoty, et al., “Novel Approach for the Development of New Antibodies Directed Against Transposase-Dervied Proteins Encoded by Human Neogenes,” Chapter 17 in Yves Bigot (ed.), Mobile Genetic Elements: Protocols and Genomic Applications, Methods in Molecular Biology, vol. 859, pp. 293-305 (2012).
Bamrungsap, S., et al., “Nanotechnology in therapeutics: a focus on nanoparticles as a drug delivery system,” Nanomedicine, vol. 7, No. 8, pp. 1253-1271 (2012).
Barouch, D.H., et al., “Mosaic HIV-1 vaccines expand the breadth and depth of cellular immune responses in rhesus monkeys,” Nature Medicine, vol. 16, No. 3, pp. 319-323 (2010)—Author Manuscript (15 total pages).
Batista, F.D., et al., “Affinity Dependence of the B Cell Response to Antigen: A Threshold, a Ceiling, and the Importance of Off-Rate,” Immunity, vol. 8, pp. 751-759 (Jun. 1998).
Batista, F.D., et al., “B cells extract and present immobilized antigen: implications for affinity discrimination,” The EMBO Journal, vol. 19, No. 4, pp. 513-520 (2000).
Binley, J.M., et al., “Enhancing the Proteolytic Maturation of Human Immunodeficiency Virus Type 1 Envelope Glycoproteins,” Journal of Virology, vol. 76, No. 6, pp. 2606-2616 (Mar. 2002).

(Continued)

*Primary Examiner* — Jeffrey S Parkin

(74) *Attorney, Agent, or Firm* — Wilmer Cutler Pickering Hale and Dorr LLP

(57) ABSTRACT

In certain aspects the invention provides HIV-1 immunogens, including HIV-1 envelope selections from individual CH505, and methods for swarm immunizations using combinations of HIV-1 envelopes.

16 Claims, 334 Drawing Sheets

Specification includes a Sequence Listing.

(56) References Cited

OTHER PUBLICATIONS

Bonsignori, M., et al., "An autoreactive antibody from an SLE/HIV-1 individual broadly neutralizes HIV-1," The Journal of Clinical Investigations, vol. 124, No. 4, pp. 1835-1843 (Apr. 2014).
Bonsignori, M., et al., "Analysis of a Clonal Lineage of HIV-1 Envelope V2/V3 Conformational Epitope-Specific Broadly Neutralizing Antibodies and Their Inferred Unmutated Common Ancestors," Journal of Virology, vol. 85, No. 19, pp. 9998-10009 (Oct. 2011).
Bonsignori, M., et al., "HIV-1 antibodies from infection and vaccination: insights for guiding vaccine design," Trends in Microbiology, vol. 20, No. 11, pp. 532-539 (Nov. 2012)—Author Manuscript (15 total pages).
Bonsignori, M., et al., "Maturation Pathway from Germline to Broad HIV-1 Neutralizer of a CD4-Mimic Antibody," Cell, vol. 165, pp. 449-463 (Apr. 7, 2016).
Bosch, V., et al., "Mutational Analysis of the Human Immunodeficiency Virus Type 1 env Gene Product Proteolytic Cleavage Site," Journal of Virology, vol. 64, No. 5, pp. 2337-2344 (May 1990).
Boyd, S.D., et al., "Measurement and Clinical Monitoring of Human Lymphocyte Clonality by Massively Parallel V-D-J Pyrosequencing," Science Translational Medicine, vol. 1, No. 12, pp. 1-10, with Editor's Summary—10 total pages (Dec. 23, 2009).
Bradley, T. et al., "Structural Constraints of Vaccine-Induced Tier-2 Autologous HIV Neutralizing Antibodies Targeting the Receptor-Binding Site," Cell Reports, vol. 14, No. 1, pp. 43-54 (Jan. 2016)—Author Manuscript (26 total pages).
Cany, J., et al., "AFP-specific immunotherapy impairs growth of autochthonous hepatocellular carcinoma in mice," Journal of Hepatology, vol. 54, pp. 115-121 (2011).
Center, R.J., et al., "Oligomeric structure of the human immunodeficiency virus type 1 envelope protein on the virion surface," Journal of Virology, vol. 76, No. 15, pp. 7863-7867 (Aug. 2002).
Chakrabarti, B.K., et al., "Modifications of the Human Immunodeficiency Virus Envelope Glycoprotein Enhance Immunogenicity for Genetic Immunization," Journal of Virology, vol. 76, No. 11, pp. 5357-5368 (Jun. 2002).
Chen, C., et al., "The site and stage of anti-DNA B-cell deletion," Nature, vol. 373, pp. 252-255 (Jan. 19, 1995).
Collaborative Computational Project, No. 4, "The CCP4 suite: programs for protein crystallography," Acta Crystallographica Section D: Biological Crystallography, vol. D50, pp. 760-763 (1994).
Dal Porto, J. M., et al., "Very low affinity B cells form germinal centers, become memory B cells, and participate in secondary immune responses when higher affinity competition is reduced," The Journal of Experimental Medicine, vol. 195, No. 9, pp. 1215-1221 (May 6, 2002).
De Taeye, S.W., et al., "Immunogenicity of Stabilized HIV-1 Envelope Trimers with Reduced Exposure of Non-neutralizing Epitopes," Cell., vol. 163, No. 7, pp. 1702-1715 (Dec. 17, 2015)—Author Manuscript (25 total pages).
Dosenovic, P., et al., "Immunization for HIV-1 Broadly Neutralizing Antibodies in Human Ig Knockin Mice," Cell, vol. 161, No. 7, pp. 1505-1515 (Jun. 18, 2015).
E. Falkowska, et al. "Broadly Neutralizing HIV Antibodies Define a Glycan-Dependent Epitope on the Prefusion Conformation of gp41 on Cleaved Envelope Trimers", Immunity, vol. 40, No. 5, pp. 657-668 (May 2014).
Edgar, R. C., "MUSCLE: Multiple Sequence Alignment with High Accuracy and High Throughput," Nucleic Acids Research, vol. 32, No. 5, pp. 1792-1797 (Mar. 19, 2004).
Felsenstein, J., "PHYLIP Phylogeny Inference Package Version 3.695," Department of Genome Sciences and Department of Biology University of Washington, pp. 1-72 (Apr. 2013).
Foote, J., et al., "Kinetic maturation of an immune response," Nature, vol. 352, pp. 530-532 (Aug. 8, 1991).
Gao, F. et al., "Antigenicity and Immunogenicity of a Synthetic Human Immunodeficiency Virus Type 1 Group M Consensus Envelope Glycoprotein," Journal of Virology, vol. 79, No. 2, pp. 1154-1163 (Jan. 2005).
Gao, F., et al., "Cooperation of B Cell Lineages in Induction of HIV-1-Broadly Neutralizing Antibodies," Cell, vol. 158, pp. 481-491 (Jul. 31, 2014).
GenBank Accession No. KC247582.1 (GenBank submission AGG24997.1), last downloaded from https://www.ncbi.nlm.nih.gov/ on May 12, 2020 (1 total page).
GenBank Accession Nos. KC247375-KC247667, last downloaded from https://www.ncbi.nlm.nih.gov/ on May 14, 2020 (182 total pages).
GenBank Accession Nos. KC575845-KC576303, last downloaded from https://www.ncbi.nlm.nih.gov/ on May 14, 2020 (86 total pages).
GenBank Accession Nos. KC576304-KC576477, last downloaded from https://www.ncbi.nlm.nih.gov/ on May 14, 2020 (33 total pages).
GenBank Accession Nos. KU570032-KU570053, last downloaded from https://www.ncbi.nlm.nih.gov/ on May 14, 2020 (5 total pages).
Georgiev, I. S., et al., "Delineating Antibody Recognition in Polyclonal Sera from Patterns of HIV-1 Isolate Neutralization," Science, vol. 340, pp. 751-756 (May 10, 2013).
Giorgi, E.E., et al., "Estimating time since infection in early homogeneous HIV-1 samples using a poisson model," BMC Bioinformatics, vol. 11, No. 532, pp. 1-7 (2010).
Goepfert, P.A., et al., "Specificity and 6-Month Durability of Immune Responses Induced by DNA and Recombinant Modified Vaccinia Ankara Vaccines Expressing HIV-1 Virus-Like Particles," Journal of Infectious Disease 2014, vol. 210, No. 1, pp. 99-110 (Jan. 7, 2014).
Gorman, J., et al., "Structures of HIV-1 Env V1V2 with broadly neutralizing antibodies reveal commonalities that enable vaccine design," Nature Structural and Molecular Biology, vol. 23, No. 1, pp. 81-90 (Jan. 2016)—Author Manuscript (34 total pages).
Graham, B.S., et al., "DNA Vaccine Delivered by a Needle-Free Injection Device Improves Potency of Priming for Antibody and CD8+ T-Cell Responses after rAd5 Boost in a Randomized Clinical Trial," Public Library of Science ONE, vol. 8, No. 4, e59340, pp. 1-11 (Apr. 8, 2013).
Gray, E.S., et al., "Isolation of a monoclonal antibody that targets the alpha-2 helix of gp120 and represents the initial autologous neutralizing-antibody response in an HIV-1 subtype C-infected individual," Journal of Virology, vol. 85, No. 15, pp. 7719-7729 (Aug. 2011).
Guo, H.-G., et al., "Characterization of an HIV-1 Point Mutant Blocked in Envelope Glycoprotein Cleavage," Virology, vol. 174, pp. 217-224 (1990).
Haynes, B.F., "New approaches to HIV vaccine development," Current Opinion in Immunology, vol. 35, pp. 39-47 (Aug. 2015)—Author Manuscript (16 total pages).
Haynes, B.F., et al., "B-cell-lineage immunogen design in vaccine development with HIV-1 as a case study," Nature Biotechnology, vol. 30, No. 5, pp. 423-433 (May 7, 2012)—Author Manuscript (30 total pages).
Haynes, B.F., et al., "Broadly Neutralizing Antibodies and the Development of Vaccines," The Journal of the American Medical Association, vol. 313, No. 24, pp. 2419-2420 (Jun. 2015).
Haynes, B.F., et al., "Cardiolipin polyspecific autoreactivity in two broadly neutralizing HIV-1 antibodies," Science, vol. 308, pp. 1906-1908 (Jun. 24, 2005).
Haynes, B.F., et al., "Host controls of HIV neutralizing antibodies," Science, vol. 344, No. 6184, pp. 588-589 (May 9, 2014)—Author Manuscript (5 total pages).
He, L., et al., "Presenting native-like trimeric HIV-1 antigens with self-assembling nanoparticles," Nature Communications, vol. 7, No. 12041, pp. 1-15 (Jun. 28, 2016).
Hraber, P., et al., "Prevalence of broadly neutralizing antibody responses during chronic HIV-1 infection," AIDS, vol. 28, No. 2, 163-169 (2014)—Author Manuscript (13 total pages).

(56) References Cited

OTHER PUBLICATIONS

Hraber, P., et al., "Longitudinal Antigenic Sequences and Sites from Intra-Host Evolution (LASSIE) Identifies Immune-Selected HIV Variants," Viruses, vol. 7, pp. 5443-5475 (Oct. 21, 2015).
International Search Report and Written Opinion dated Aug. 4, 2017 in PCT/US2017/020249 (13 total pages).
Jardine, J., et al., "Rational HIV immunogen design to target specific germline B cell receptors," Science, vol. 340, No. 6133, pp. 711-716 (May 10, 2013)—Author Manuscript (13 total pages).
Jardine, J.G., et al., "HIV-1 broadly neutralizing antibody precursor B cells revealed by germline-targeting immunogen," Science, vol. 351, No. 6280, pp. 1458-1463 (Mar. 25, 2016).
Jardine, J.G., et al., "Priming a broadly neutralizing antibody response to HIV-1 using a germline-targeting immunogen," Science, vol. 349, No. 6244, pp. 156-161 (Jul. 10, 2015)—Author Manuscript (20 pages).
Julien, J-P., et al., "Design and structure of two HIV-1 clade C SOSIP.664 trimers that increase the arsenal of native-like Env immunogens," Proceedings of the National Academy of Sciences of the United States of America, vol. 112, No. 38, pp. 11947-11952 (Sep. 22, 2015).
Keele, B.F., et al., "Identification and characterization of transmitted and early founder virus envelopes in primary HIV-1 infection," Proceedings of the National Academy of Sciences of the United States of America, vol. 105, No. 21, pp. 7552-7557 (May 27, 2008).
Kepler, T.B., "Reconstructing a B-cell clonal lineage. I. Statistical inference of unobserved ancestors," F1000Res earch, vol. 2, No. 103, pp. 1-12 (Jan. 22, 2014).
Kepler, T. B., et al., "Reconstructing a B-Cell Clonal Lineage. II. Mutation, Selection, and Affinity Maturation," Frontiers in Immunology, vol. 5, No. 170, pp. 1-10 (Apr. 22, 2014).
Kepler, T.B., et al., "Somatic Hypermutation in B Cells: an Optimal Cootrol Treatment," Journal of Theoretical Biology, vol. 164, pp. 37-64 (1993).
Kibler, K.V., et al., "Improved NYVAC Based Vaccine Vectors," Public Library of Science ONE, vol. 6, Issue 11, e25674, pp. 1-13 (Nov. 9, 2011).
Klein, F., et al., "Somatic mutations of the immunoglobulin framework are generally required for broad and potent HIV-1 neutralization," Cell, vol. 153, pp. 126-138 (Mar. 28, 2013).
Kwon, Y.D., et al., "Crystal structure, conformational fixation, and entry-related interactions of mature ligand-free HIV-1 Env," Nature Structural & Molecular Biology, vol. 22 No. 7, pp. 522-531 (Jul. 2015)—Author Manuscript—30 pages.
Lander, G.C., et al., "Appion: an integrated, database-driven pipeline to facilitate EM image processing," Journal of Structural Biology, vol. 166, No. 1, pp. 95-102 (Apr. 2009)—Author Manuscript (16 total pages).
Li, Y., et al., "Control of expression, glycosylation, and secretion of HIV-1 gp120 by homologous and heterologous signal sequences," Virology, vol. 204, No. 1, pp. 266-278 (1994).
Li, Y., et al., "Effects of inefficient cleavage of the signal sequence of HIV-1 gpl20 on its association with calnexin, folding, and intracellular transport," Proceedings of the National Academy of Sciences of the United States of America, vol. 93, pp. 9606-9611 (Sep. 1996).
Liao, H.X., et al., "Antigenicity and Immunogenicity of Transmitted/Founder, Consensus, and Chronic Envelope Glycoproteins of Human Immunodeficiency Virus Type 1," Journal of Virology, vol. 87, No. 8, pp. 4185-4201 (Apr. 2013).
Liao, H.X., et al., "Co-evolution of a broadly neutralizing HIV-1 antibody and founder virus," Nature, vol. 496, No. 7446, pp. 469-476 (Apr. 25, 2013)—Author Manuscript (25 total pages).
Liao, H.X., et al., "Initial antibodies binding to HIV-1 gp41 in acutely infected subjects are polyreactive and highly mutated," Journal of Experimental Medicine, vol. 208, No. 11, pp. 2237-2249 (2011).
Liu, M., et al., "Polyreactivity and Autoreactivity Among HIV-1 Antibodies," Journal of Virology, vol. 89, No. 1, pp. 784-798 (Jan. 2015).
Mascola, J.R., et al., "HIV-1 neutralizing antibodies: understanding nature's pathways," Immunol. Rev., vol. 254, No. 1, pp. 225-244 (Jul. 2013)—Author Manuscript (29 total pages).
McCune, J.M., et al., "Endoproteolytic Cleavage of gp160 Is Required for the Activation of Human Immunodeficiency Virus," Cell, vol. 53, pp. 55-67 (Apr. 8, 1988).
McDonald, I.K., et al., "Satisfying hydrogen bonding potential in proteins," Journal Molecular Biology, vol. 238, pp. 777-793 (1994).
McGuire, A.T., et al., "Engineering HIV envelope protein to activate germline B cell recept+C35ors of broadly neutralizing anti-CD4 binding site antibodies," Journal of Experimental Medicine, vol. 210, No. 4, pp. 1-9 (Mar. 25, 2013).
McGuire, A.T., et al., "Specifically modified Env immunogens activate B-cell precursors of broadly neutralizing HIV-1 antibodies in transgenic mice," Nature Communications, vol. 7, No. 10618, pp. 1-10 (Feb. 24, 2016).
Meffre, E., et al., "Itnmunoglobulin heavy chain expression shapes the B cell receptor repertoire in human B cell development," The Journal of Clinical Investigation, vol. 108, No. 6, pp. 879-886 (Sep. 2001).
Moody, M.A., et al., "Toll-Like Receptor 7 /8 (TLR7 /8) and TLR9 Agonists Cooperate to Enhance HIV-I Envelope Antibody Responses in Rhesus Macaques," Journal of Virology, vol. 88, No. 6, pp. 3329-3339 (Mar. 2014).
Morris, L., et al., "Isolation of a human anti-HIV gp41 membrane proximal region neutralizing antibody by antigen-specific single B cell sorting," Public Library of Science One, vol. 6, No. 9, e23532, pp. 1-10 (Sep. 2011).
NCBI Sequence Reads Arcvhive No. SRP067168 last downloaded from https://www.ncbi.nlm.nih.gov/ on May 12, 2020 (5 total pages).
Otwinowski, Z., et al., "Processing of X-ray diffraction data collected in oscillation mode," Methods in Enzymology, vol. 276, pp. 307-326.
Parren, P.W.H.I., et al., "Antibody Neutralization-Resistant Primary Isolates of Human Immunodeficiency Virus Type 1," Journal of Virology, vol. 72, No. 12, pp. 10270-10274 (Dec. 1998).
Perreau, M., et al., "DNA/NYVAC Vaccine Regimen Induces HIV-Specific CD4 and CD8 T-Cell Responses in Intestinal Mucosa," Journal of Virology, vol. 85, No. 19, pp. 9854-9862 (Oct. 2011).
Pettersen, E.F., et al., "UCSF Chimera—a visualization system for exploratory research and analysis," Journal of Computational Chemistry, vol. 25, No. 13, pp. 1605-1612 (2004).
Poignard, P., et al., "Heterogeneity of envelope molecules expressed on primary human immunodeficiency virus type 1 particles as probed by the binding of neutralizing and nonneutralizing antibodies.," Journal of Virology, vol. 77, No. 1, pp. 353-365 (Jan. 2003).
Proft, T., "Sortase-mediated protein ligation: an emerging biotechnology tool for protein modification and immobilisation," Biotechnology Letters, vol. 32, No. 1, pp. 1-11 (Sep. 1, 2009).
Protein Data Bank No. PDB ID 5F90, last downloaded from https://www.ncbi.nlm.nih.gov/protein on May 15, 2020 (1 total page).
Protein Data Bank No. PDB ID 5F96, last downloaded from https://www.ncbi.nlm.nih.gov/protein on May 15, 2020 (1 total page).
Protein Data Bank No. PDB ID 5F9W, last downloaded from https://www.ncbi.nlm.nih.gov/protein on May 15, 2020 (2 total pages).
Pugach, P., et al. "A Native-Like SOSIP.664 Trimer Based on an HIV-1 Subtype B env Gene," Journal of Virology, vol. 89, No. 6, pp. 3380-3395 (Mar. 2015).
Ringe, R.P., et al., "Influences on the Design and Purification of Soluble, Recombinant Native-Like HIV-1 Envelope Glycoprotein Trimers," Journal of Virology, vol. 89, No. 23, pp. 12189-12210 (Dec. 2015).
Rudicell, R.S., et al., "Enhanced Potency of a Broadly Neutralizing HIV-1 Antibody In Vitro Improves Protection against Lentiviral Infection In Vivo," Journal of Virology, vol. 88, No. 21, pp. 12669-12682 (Nov. 2014).
Sanders, R.W., et al., "A Next-Generation Cleaved, Soluble HIV-1 Env Trimer, BG505 SOSIP.664 gp140, Expresses Multiple Epitopes

(56) References Cited

OTHER PUBLICATIONS for Broadly Neutralizing but Not Non-Neutralizing Antibodies," Public Library of Science Pathogens, vol. 9, No. 9, e1003618, pp. 1-20 (Sep. 2013).
Sanders, R.W., et al., "HIV-1 neutralizing antibodies induced by native-like envelope trimers," Science, vol. 349, No. 6244, pp. 154, aac4223-1-aac4223-10, 13 pages (Jul. 10, 2015).
Santra, S., et al., "Mosaic Vaccines Elicit CD8+ T lymphocyte Responses in Monkeys that Confer Enhanced Immune Coverage of Diverse HIV Strains," Nature Medicine, vol. 16, No. 3, pp. 324-328 (Mar. 2010)—Author Manuscript (13 total pages).
Scheid, J.F., et al., "Broad diversity of neutralizing antibodies isolated from memory B cells in HIV-infected individuals," Nature, vol. 458, pp. 636-640 (Apr. 2009).
Scheid, J.F., et al., "Sequence and structural convergence of broad and potent HIV antibodies that mimic CD4 binding," Science, vol. 333, No. 6049, pp. 1633-1637 (Sep. 16, 2011)—Author Manuscript (11 total pages).
Scheres, S.H.W., "A Bayesian view on cryo-EM structure determination," Journal of Molecular Biology, vol. 415, No. 2, pp. 406-418, 20 total pages (Jan. 13, 2012).
Schmohl, L., et al., "Sortase-mediated ligations for the site-specific modification of proteins," Current Opinion in Chemical Biology, vol. 22, pp. 122-128 (Oct. 2014).
Seaman, M. S., et al., "Tiered Categorization of a Diverse Panel of HIV-1 Env Pseudoviruses for Assessment of Neutralizing Antibodies," Journal of Virology, vol. 84, No. 3, pp. 1439-1452 (Feb. 2010).
Shih, T.A., et al., "Role of BCR affinity in T cell-dependent antibody responses in vivo," Nature immunology, vol. 3, No. 6, pp. 570-575 (Jun. 2002).
Shiokawa, S., et al., "IgM Heavy Chain Complementarity-Determining Region 3 Diversity Is Constrained by Genetic and Somatic Mechanisms Until Two Months After Birth," Journal of Immunology, vol. 162, pp. 6060-6070 (1999).
Sliepen, K., et al., "Presenting native-like HIV-1 envelope trimers on ferritin nanoparticles improves their immunogenicity," Retrovirology, vol. 12, No. 82, 5 total pages (2015).
Sui, Z., et al., "Cross-protection against influenza virus infection by intranasal administration of M2-based vaccine with chitosan as an adjuvant," Archives of Virology, vol. 155, No. 4, pp. 535-544 (2010).
Tabata, A., et al., "Development of a Sortase A-mediated Peptide-labeled Liposome Applicable to Drug-delivery Systems," Anticancer Research, vol. 35, No. 8, pp. 4411-4417 (May 2015).
Tang, G., et al., "EMAN2: An Extensible Image Processing Suite for Electron Microscopy," Journal of Structural Biology, vol. 157, No. 1, pp. 38-46, 9 total pages (Jan. 2007).
Tomaras, G.D., et al., "Initial B-Cell Responses to Transmitted Human Immunodeficiency Virus Type 1: Virion-Binding Immunoglobulin M (IgM) and IgG Antibodies Followed by Plasma Anti-gp41 Antibodies with Ineffective Control of Initial Viremia," Journal of Virology, vol. 82, No. 24, pp. 12449-12463 (Dec. 2008).
Tsukiji, S., et al., "Sortase-Mediated Ligation: A Gift from Gram-Positive Bacteria to Protein Engineering," ChemBioChem, vol. 10, pp. 787-798 (2009).
Van Dongen, J.J., et al., "Design and standardization of PCR primers and protocols for detection of clonal immunoglobulin and T-cell receptor gene recombinations in suspect lymphoproliferations: report of the BIOMED-2 Concerted Action BMH4-CT98-3936," Leukemia, vol. 17, pp. 2257-2317 (2003).
Venturi, V., et al., "A mechanism for TCR sharing between T cell subsets and individuals revealed by pyrosequencing," The Journal of Immunology, vol. 186, pp. 4285-4294 (2011).
Verkoczy, L., et al., "Autoreactivity in an HIV-1 Broadly Reactive Neutralizing Antibody Variable Region Heavy Chain Induces Immunologic Tolerance," Proceedings of the National Academy of Sciences of the United States of America, vol. 107, No. 1, pp. 181-186 (Jan. 5, 2010).
Verkoczy, L., et al., "Induction of HIV-1 broad neutralizing antibodies in 2F5 knock-in mice: selection against membrane proximal external region-associated autoreactivity limits T-dependent responses," The Journal of Immunology, vol. 191, No. 5 (Sep. 2013)—Author Manuscript (24 total pages).
Verkoczy, L., et al., "Rescue of HIV-1 Broad Neutralizing Antibody-Expressing B Cells in 2F5 VH X VL Knockin Mice Reveals Multiple Tolerance Controls," Journal of Immunology, vol. 187, pp. 3785-3797 (2011).
Verkoczy, L., et al., "Role of immune mechanisms in induction of HIV-1 broadly neutralizing antibodies," Current Opinion in Immunology, vol. 23, No. 3, pp. 383-390 (Jun. 2011)—Author Manuscript (12 total pages).
Wu, X., et al., "Focused evolution ofHIV-1 neutralizing antibodies revealed by structures and deep sequencing," Science, vol. 333, No. 6049, pp. 1593-1602 (Sep. 16, 2011)—Author Manuscript (17 total pages).
Wu, X., et al., "Maturation and Diversity of the VRC01-Antibody Lineage over 15 Years of Chronic HIV-1 Infection," Cell, vol. 161, No. 3, pp. 470-485 (Apr. 23, 2015)—Author Manuscript (31 total pages).
Wu, X., et al., "Rational design of envelope identifies broadly neutralizing human monoclonal antibodies to HIV-1," Science, vol. 329, No. 5993, pp. 856-861 (Aug. 13, 2010)—Author Manuscript (12 total pages).
Yang, G., et al., "Identification of autoantigens recognized by the 2F5 and 4E10 broadly neutralizing HIV-1 antibodies," Journal of Experimental Medicine, vol. 210, No. 2, pp. 241-256 (2013).
Yang. X., et al., "Antibody binding is a dominant determinant of the efficiency of human immunodeficiency virus type 1 neutralization," Journal of Virology, vol. 80, No. 22, pp. 11404-11408 (Nov. 2006).
Yu, J.S., et al., "Recombinant *Mycobacterium bovis* Bacillus Calmette-Guerin Elicits Human Immunodeficiency Virus Type 1 Envelope-Specific T Lymphocytes at Mucosal Sites," Clinical and Vaccine Immunology, vol. 14, No. 7, pp. 886-893 (Jul. 2007).
Zhang, J., et al., "Optimality of Mutation and Selection in Germinal Centers," Public Library of Science Computational Biology, vol. 6, No. 6, pp. 1-9, e1000800, (Jun. 2010).
Zhou, T., et al., "Structural basis for broad and potent neutralization of HIV-1 by antibody VRC01," Science, vol. 329, No. 5993, pp. 811-817 (Aug. 13, 2010)—Author Manuscript (19 total pages).
Zhou, T., et al., "Structural definition of a conserved neutralization epitope on HIV-1 gp120," Nature, vol. 445, No. 7129, pp. 732-737 (Feb. 15, 2007)—Author Manuscript (15 total pages).
Zhou, T., et al., "Structural Repertoire of HIV-1-Neutralizing Antibodies Targeting the CD4 Supersite in 14 Donors," Cell, vol. 161, No. 6, pp. 1280-1292 (Jun. 4, 2015)—Author Manuscript (26 total pages).
Liao, H.-X., et al., "A group M consensus envelope glycoprotein induces antibodies that neutralize subsets of subtype B and C HIV-1 primary viruses," Virology, vol. 353, pp. 268-282 (Jul. 2006).
NCBI Sequence Reads Arcvhive No. SRP067168 last downloaded from https://www.ncbi.nlm.nih.gov/ on Jun. 25, 2020 (6 total pages)—re-submission of NCBI Sequence Reads Arcvhive No. SRP067168 submitted in Information Disclosure Statement filed May 18, 2020 to make complete reference of record.

| Plasmid ID | Env name | Vector | 3' Bar code |
|---|---|---|---|
| HV1300656 | CH505.M5gp145 | VRC8400 | **TGATGAG**gtgaccgaattcgggacccggatcc (SEQ ID NO. 19) |
| HV1300662 | CH505.M11gp145 | VRC8400 | **TGATGAG**gtgaccgaattcaggtcccggatcc(SEQ ID NO. 20) |
| HV1300635 | CH505w020.14gp145 | VRC8400 | **TGATGAG**ggacccgaattcggtcaccggatcc(SEQ ID NO. 21) |
| HV1300636 | CH505w030.28gp145 | VRC8400 | **TGATGAG**ggtcctgaattcggttaccggatcc(SEQ ID NO. 22) |
| HV1300639 | CH505w078.15gp145 | VRC8400 | **TGATGAG**aattcggtcaccgggtcctggatcc(SEQ ID NO. 23) |
| HV1300638 | CH505w053.31gp145 | VRC8400 | **TGATGAG**aattcggtgaccgggacctggatcc(SEQ ID NO. 24) |

CH505 Env gp145 and gp120 gene constructs were cloned into VRC8400 at the unique SalI and BamHI sites.

>HV1300656, CH505.M5gp145 (SEQ ID NO. 25)
gtcgacaagaagccaccATGCGCGTGATGGGCATCCAGCGCAACTACCCGCAGTGGTGGATCTGGTCGATGCTGGGCTT
CTGGATGCTCATGATCTGCAACGGCATGTGGGTGACGGTGTACTACGGCGTGCCGGTGTGGAAGGAGGCCAAGACGACC
CTGTTCTGCGCGTCGGACGCCAAGGCCTACGAGAAGGAGGTGCACAACGTGTGGGCGACCCACGCCTGCGTGCCCACGG
ACCCCAACCCGCAGGAGATGGTGCTGAAGAACGTGACCGAGAACTTCAACATGTGGAAGAACGACATGGTGGACCAGAT
GCACGAGGACGTGATCTCCCTGTGGGACCAGTCCCTGAAGCCCTGCGTGAAGCTGACCCCGCTGTGCGTGACCCTGAAC
TGCACCAACGCCACCGCGTCCAACTCCTCCATCATCGAGGGCATGAAGAACTGCTCCTTCAACATCACGACGGAGCTGC
GCGACAAGCGCGAGAAGAAGAACGCCCTGTTCTACAAGCTGGACATCGTGCAGCTGGACGGCAACTCCTCGCAGTACAG
GCTGATCAACTGCAACACCTCCGTCATCACGCAGGCGTGCCCCAAGGTGTCCTTCGACCCCATCCCCATCCACTACTGC
GCCCCCGCCGGCTACGCCATCCTGAAGTGCAACAACAAGACCTTCACCGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCAT
CATCCGGTCCGAGAACATCACGAAGAACGTGAAGACCATCATCGTGCACCTGAACGAGTCCGTGAAGATCGAGTGCACC
CGCCCGAACAACAAGACGCGCACCTCCATCCGGATCGGCCCTGGCCAGGCCTTCTACGCCACCGGCCAGGTGATCGGCG
ACATCCGCGAGGCGTACTGCAACATCAACGAGTCCAAGTGGAACGAGACCCTGCAGCGCGTGTCCAAGAAGCTGAAGGA
GTACTTCCCCCACAAGAACATCACCTTCCAGCCGTCGTCCGGCGGCGACCTCGAGATCACCACGCACTCCTTCAACTGC
GGTGGCGAGTTCTTCTACTGCAACACGTCGTCGCTGTTCAACCGCACCTACATGGCCAACTCCACCGACATGGCCAACT
CCACCGAGACCAACTCCACGCGCACCATCACGATCCACTGCCGCATCAAGCAGATCATCAACATGTGGCAGGAGGTGGG
CCGCGCCATGTACGCACCGCCCATCGCCGGCAACATCACCTGCATCTCCAACATCACCGGCCTCCTGCTGACCCGCGAC
GGCGGCAAGAACAACACGGAGACCTTCAGGCCAGGCGGAGGCAACATGAAGGACAACTGGCGCTCCGAGCTGTACAAGT
ACAAGGTGGTGGAGGTGAAGCCCCTGGGCGTGGCACCCACCAACGCCCGCAGGCGCGTCGTGGAGCGCGAGAAGCGCGC
CGTGGGCATGGGCGCCGTGTTCCTGGGCTTCCTGGGCGCTGCGGGCTCCACCATGGGTGCCGCGTCCATCACCCTGACC
GTGCAGGCCCGCCAGCTGCTCTCCGGCATCGTGCAGCAGCAGTCCAACCTCCTGAAGGCCATCGAGGCCCAGCAGCACA
TGCTGAAGCTGACCGTGTGGGGCATCAAGCAGCTGCAGGCCAGGGTGCTCGCGCTCGAGCGCTACCTGAAGGACCAGCA
GCTGCTCGGCATGTGGGGCTGCTCCGGCAAGCTGATCTGCACCACCAACGTGTACTGGAACTCGTCCTGGTCCAACAAG
ACCTACGGCGACATCTGGGACAACATGACCTGGATGCAGTGGGAGCGCGAGATCTCCAACTACACCGAGATCATCTACG
AGCTCCTCGAGGAGTCCCAGAACCAGCAGGAGAAGAACGAGCAGGATCTGCTCGCGCTGGACCGCTGGAACTCCCTGTG
GAACTGGTTCAACATCACCAACTGGCTGTGGTACATCAAGATCTTCATCATGATCGTGGGCGGCCTGATCGGCCTGCGC
ATCATCTTCGCCGTGCTGTCGCTGGTGAACCGCGTGCGCCAGGGCTGATGAGgtgaccgaattcgggacccggatcc

Figure 1

>HV1300662, CH505.M1gp145 (SEQ ID NO. 26)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCATGTGGGTGACGGTGTACTACGGCGTGCCGGTGTGGAAGGAGGCCAAGACGACC
CTGTTCTGCGCGTCGGACGCCAAGGCCTACGAGAAGGAGGTGCACAACGTGTGGGCGACCCACGCCTGCGTGCCCACGG
ACCCCAACCCGCAGGAGATGGTGCTGAAGAACGTGACCGAGAACTTCAACATGTGGAAGAACGACATGGTGGACCAGAT
GCACGAGGACGTGATCTCCCTGTGGGACCAGTCCCTGAAGCCCTGCGTGAAGCTGACCCCGCTGTGCGTGACCCTGAAC
TGCACCAACGCCACCGCGTCCAACTCCTCCATCATCGAGGGCATGAAGAACTGCTCCTTCAACATCACGACGGAGCTGC
GCGACAAGCGCGAGAAGAAGAACGCCCTGTTCTACAAGCTGGACATCGTGCAGCTGGACGGCAACTCCTCGCAGTACAG
GCTGATCAACTGCAACACCTCCGTCATCACGCAGGCGTGCCCCAAGGTGTCCTTCGACCCCATCCCCATCCACTACTGC
GCCCCCGCCGGCTACGCCATCCTGAAGTGCAACAACAAGACCTTCACCGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCAT
CATCCGGTCCGAGAACATCACGGACAACGGGAAGACCATCATCGTGCACCTGAACGAGTCCGTGAAGATCGAGTGCACC
CGCCCGAACAACAAGACGCGCACCTCCATCCGGATCGGCCCTGGCCAGGCCTTCTACGCCACCGGCCAGGTGATCGGCG
ACATCCGCGAGGCGTACTGCAACATCAACGAGTCCAAGTGGAACGAGACCCTGCAGCGCGTGTCCAAGAAGCTGAAGGA
GTACTTCCCCCACAAGAACATCACCTTCCAGCCGTCGTCCGGCGGCGACCTCGAGATCACCACGCACTCCTTCAACTGC
GGTGGCGAGTTCTTCTACTGCAACACGTCGTCGCTGTTCAACCGCACCTACATGGCCAACTCCACCGACATGGCCAACT
CCACCGAGACCAACTCCACGCGCACCATCACGATCCACTGCCGCATCAAGCAGATCATCAACATGTGGCAGGAGGTGGG
CCGCGCCATGTACGCACCGCCCATCGCCGGCAACATCACCTGCATCTCCAACATCACCGGCCTCCTGCTGACCCGCGAC
GGCGGCAAGAACAACACGGAGACCTTCAGGCCAGGCGGAGGCAACATGAAGGACAACTGGCGCTCCGAGCTGTACAAGT
ACAAGGTGGTGGAGGTGAAGCCCCTGGGCGTGGCACCCACCAACGCCCGCAGGCGCGTCGTGGAGCGCGAGAAGCGCGC
CGTGGGCATGGGCGCCGTGTTCCTGGGCTTCCTGGGCGCTGCGGGCTCCACCATGGGTGCCGCGTCCATCACCCTGACC
GTGCAGGCCCGCCAGCTGCTCTCCGGCATCGTGCAGCAGCAGTCCAACCTCCTGAAGGCCATCGAGGCCCAGCAGCACA
TGCTGAAGCTGACCGTGTGGGGCATCAAGCAGCTGCAGGCCAGGGTGCTCGCGCTCGAGCGCTACCTGAAGGACCAGCA
GCTGCTCGGCATGTGGGGCTGCTCCGGCAAGCTGATCTGCACCACCAACGTGTACTGGAACTCGTCCTGGTCCAACAAG
ACCTACGGCGACATCTGGGACAACATGACCTGGATGCAGTGGGAGCGCGAGATCTCCAACTACACCGAGATCATCTACG
AGCTCCTCGAGGAGTCCCAGAACCAGCAGGAGAAGAACGAGCAGGATCTGCTCGCGCTGGACCGCTGGAACTCCCTGTG
GAACTGGTTCAACATCACCAACTGGCTGTGGTACATCAAGATCTTCATCATGATCGTGGGCGGCCTGATCGGCCTGCGC
ATCATCTTCGCCGTGCTGTCGCTGGTGAACCGCGTGCGCCAGGGCTGATGAGgtgaccgaattcaggtcccggatcc

Figure 1 cont.

>HV1300635, CH505w020.14gp145 (SEQ ID NO. 27)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCATGTGGGTGACGGTGTACTACGGCGTGCCGGTGTGGAAGGAGGCCAAGACGACC
CTGTTCTGCGCGTCGGACGCCAAGGCCTACGAGAAGGAGGTGCACAACGTGTGGGCGACCCACGCCTGCGTGCCCACGG
ACCCCAACCCGCAGGAGATGGTGCTGAAGAACGTGACCGAGAACTTCAACATGTGGAAGAACGACATGGTGGACCAGAT
GCACGAGGACGTGATCTCCCTGTGGGACCAGTCCCTGAAGCCCTGCGTGAAGCTGACCCCGCTGTGCGTGACCCTGAAC
TGCACCAACGCCACCGCGTCCAACAACTCCATCATCGAGGGCATGAAGAACTGCTCCTTCAACATCACGACGGAGCTGC
GCGACAAGCGCGAGAAGAAGAACGCCCTGTTCTACAAGCTGGACATCGTGCAGCTGGACGGCAACTCCTCGCAGTACAG
GCTGATCAACTGCAACACCTCCGTCATCACGCAGGCGTGCCCCAAGGTGTCCTTCGACCCCATCCCCATCCACTACTGC
GCCCCCGCCGGCTACGCCATCCTGAAGTGCAACAACAAGACCTTCACCGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCAT
CATCCGGTCCGAGAACATCACGAACAACGCGAAGACCATCATCGTGCACCTGAACGAGTCCGTGAAGATCGAGTGCACC
CGCCCGAACAACAAGACGCGCACGTCCATCCGGATCGGCCCTGGCCAGGCCTTCTACGCCACCGGCCAGGTGATCGGCG
ACATCCGCAAGGCGTACTGCAACATCTCGGAGTCCAAGTGGAACGAGACCCTGCAGCGCGTGTCCAAGAAGCTGAAGGA
GTACTTCCCCCACAAGAACATCACCTTCCAGCCGTCGTCCGGCGGCGACCTCGAGATCACCACGCACTCCTTCAACTGC
GGTGGCGAGTTCTTCTACTGCAACACGTCGTCGCTGTTCAACCGCACCTACATGGCCAACTCCACCGACATGGCCAACT
CCACCGAGACCAACTCCACGCGCACCATCACGCTCCACTGCCGCATCAAGCAGATCATCAACATGTGGCAGGAGGTGGG
CCGCGCCATGTACGCACCGCCCATCGCCGGCAACATCACCTGCATCTCCAACATCACCGGCCTCCTGCTGACCCGCGAC
GGCGGCAAGAACAACACGGAGACCTTCAGGCCAGGCGGAGGCAACATGAAGGACAACTGGCGCTCCGAGCTGTACAAGT
ACAAGGTGGTGGAGGTGAAGCCCCTGGGCGTGGCACCCACCAACGCCCGCAGGCGCGTCGTGGAGCGCGAGAAGCGCGC
CGTGGGCATGGGCGCCGTGTTCCTGGGCTTCCTGGGCGCTGCGGGCTCCACCATGGGTGCCGCGTCCATCACCCTGACC
GTGCAGGCCCGCCAGCTGCTCTCCGGCATCGTGCAGCAGCAGTCCAACCTCCTGAAGGCCATCGAGGCCCAGCAGCACA
TGCTGAAGCTGACCGTGTGGGGCATCAAGCAGCTGCAGGCCAGGGTGCTCGCGCTCGAGCGCTACCTGAAGGACCAGCA
GCTGCTCGGCATGTGGGGCTGCTCCGGCAAGCTGATCTGCACCACCAACGTGTACTGGAACTCGTCCTGGTCCAACAAG
ACCTACGGCGACATCTGGGACAACATGACCTGGATGCAGTGGGAGCGCGAGATCTCCAACTACACCGAGATCATCTACG
AGCTCCTCGAGGAGTCCCAGAACCAGCAGGAGAAGAACGAGCAGGATCTGCTCGCGCTGGACCGCTGGAACTCCCTGTG
GAACTGGTTCAACATCACCAACTGGCTGTGGTACATCAAGATCTTCATCATGATCGTGGGCGGCCTGATCGGCCTGCGC
ATCATCTTCGCCGTGCTGTCGCTGGTGAACCGCGTGCGCCAGGGCTGATGAGggacccgaattcggtcaccggatcc

Figure 1 cont.

>HV1300636, CH505w030.28gp145 (SEQ ID NO. 28)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCATGTGGGTGACGGTGTACTACGGCGTGCCGGTGTGGAAGGAGGCCAAGACGACC
CTGTTCTGCGCGTCGGACGCCAAGGCCTACGAGAAGGAGGTGCACAACGTGTGGGCGACCCACGCCTGCGTGCCCACGG
ACCCCAACCCGCAGGAGATGGTGCTGAAGAACGTGACCGAGAACTTCAACATGTGGAAGAACGACATGGTGGACCAGAT
GCACGAGGACGTGATCTCCCTGTGGGACCAGTCCCTGAAGCCCTGCGTGAAGATGACCCCGCTGTGCGTGACCCTGAAC
TGCACCAACGCCACCGCGATCAACTCCTCCATCATCGAGGGCATGAAGAACTGCTCCTTCAACATCACGACGGAGCTGC
GCGACAAGCGCGAGAAGAAGAACGCCCTGTTCTACAAGCTGGACATCGTGCAGCTGGACGGCAACTCCTCGCAGTACAG
GCTGATCAACTGCAACACCTCCGTCATCACGCAGGCGTGCCCCAAGGTGTCCTTCGACCCCATCCCCATCCACTACTGC
GCCCCCGCCGGCTACGCCATCCTGAAGTGCAACAACAAGACCTTCACCGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCAT
CATCCGGTCCGAGAACATCACGAACAACGACAAGACCATCATCGTGCACCTGAACGAGTCCGTGAAGATCGAGTGCACC
CGCCCGAACAACAAGACGCGCACCTCCATCCGGATCGGCCCTGGCCAGGCCTTCTACGCCACCGGCCAGGTGATCGGCG
ACATCCGCGAGGCGCACTGCAACATCTCGGAGTCCAAGTGGAACGAGACCCTGCAGCGCGTGTCCAAGAAGCTGAAGGA
GTACTTCCCCCACAAGAACATCACCTTCCAGCCGTCGTCCGGCGGCGACCTCGAGATCACCACGCACTCCTTCAACTGC
GGTGGCGAGTTCTTCTACTGCAACACGTCGTCGCTGTTCAACCGCACCTACATGGCCAACTCCACCGACATGGCCAACT
CCACCGAGACCAACTCCACGCGCACCATCACGATCCGCTGCCGCATCAAGCAGATCATCAACATGTGGCAGGAGGTGGG
CCGCGCCATGTACGCACCGCCCATCGCCGGCAACATCACCTGCATCTCCAACATCACCGGCCTCCTGCTGACCCGCGAC
GGCGGCAAGAACAACACGGAGACCTTCAGGCCAGGCGGAGGCAACATGAAGGACAACTGGCGCTCCGAGCTGTACAAGT
ACAAGGTGGTGGAGGTGAAGCCCCTGGGCGTGGCACCCACCAACGCCCGCAGGCGCGTCGTGGAGCGCGAGAAGCGCGC
CGTGGGCATGGGCGCCGTGTTCCTGGGCTTCCTGGGCGCTGCGGGCTCCACCATGGGTGCCGCGTCCATCACCCTGACC
GTGCAGGCCCGCCAGCTGCTCTCCGGCATCGTGCAGCAGCAGTCCAACCTCCTGAAGGCCATCGAGGCCCAGCAGCACA
TGCTGAAGCTGACCGTGTGGGGCATCAAGCAGCTGCAGGCCAGGGTGCTCGCGCTCGAGCGCTACCTGAAGGACCAGCA
GCTGCTCGGCATGTGGGGCTGCTCCGGCAAGCTGATCTGCACCACCAACGTGTACTGGAACTCGTCCTGGTCCAACAAG
AGCTACGGCGACATCTGGGACAACATGACCTGGATGCAGTGGGAGCGCGAGATCTCCAACTACACCGAGATCATCTACG
AGCTCCTCGAGGAGTCCCAGAACCAGCAGGAGAAGAACGAGCAGGATCTGCTCGCGCTGGACCGCTGGAACTCCCTGTG
GAACTGGTTCAACATCACCAACTGGCTGTGGTACATCAAGATCTTCATCATGATCGTGGGCGGCCTGATCGGCCTGCGC
ATCATCTTCGCCGTGCTGTCGCTGGTGAACCGCGTGCGCCAGGGCTGATGAGggtcctgaattcggttaccggatcc

Figure 1 cont.

>HV1300639, CH505w078.15gp145 (SEQ ID NO. 29)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCATGTGGGTGACGGTGTACTACGGCGTGCCGGTGTGGAAGGAGGCCAAGACGACC
CTGTTCTGCGCGTCGGACGCCAAGGCCTACGAGAAGGAGGTGCACAACGTGTGGGCGACCCACGCCTGCGTGCCCACGG
ACCCCAACCCGCAGGAGATGGTGCTGAAGAACGTGACCGAGAACTTCAACATGTGGAAGAACGACATGGTGGACCAGAT
GCACGAGGACGTGATCTCCCTGTGGGACCAGTCCCTGAAGCCCTGCGTGAAGCTGACCCCGCTGTGCGTGACCCTGAGC
TGCACGAACGCCACCAACGCGACGGCGTCGAACTCGTCCATCCTCGAGGGGATGAAGAACTGCTCCTTCAACATCACGA
CGGAGCTGCGCGACAAGCGCGAGAAGAAGAACGCCCTGTTCTACAAGCTGGACATCGTGCAGCTGGACGGCAACTCCTC
GCAGTACAGGCTGATCAACTGCAACACCTCCGTCATCACGCAGGCGTGCCCCAAGGTGTCCTTCGACCCCATCCCCATC
CACTACTGCGCCCCCGCCGGCTACGCCATCCTGAAGTGCAACAACAAGACCTTCAACGGCACCGGCCCGTGCAACAACG
TGTCCACCGTGCAGTGCACGCACGGGATCAAGCCCGTGGTGTCCACGCAGCTGCTCCTGAACGGGTCGCTGGCCGAGGG
CGAGATCATCATCCGGTCGAAGAACATCACGGACAACGGGAAGACCATCATCGTGCACCTGAACGAGTCCGTGAAGATC
GAGTGCACCCGCCCGAGCAACAACACGCGCACCTCCATCCGGATCGGCCCTGGCCAGGCCTTCTACGCCACCGGCCAGG
TGATCGGCGACATCCGCGAGGCGCACTGCAACATCTCCGAGTCCAAGTGGAACGAGACCCTGCAGCGCGTGTCCGAGAA
GCTGAAGGAGTACTTCCCCCACAAGAACATCACCTTCCAGCCGTCGTCCGGCGGCGACCTCGAGATCACCACGCACTCC
TTCAACTGCGGTGGCGAGTTCTTCTACTGCAACACGTCGTCGCTGTTCAACCGCACCTACATGGCCACCTCCACCGACA
TGGCCAACTCCACCGAGACCAACTCCACGCGCATCATCACGATCCGCTGCCGCATCAAGCAGATCATCAACATGTGGCA
GGAGGTGGGCCGCGCCATGTACGCACCGCCCATCGCCGGCAACATCACCTGCATCTCCAACATCACCGGCCTCCTGCTG
ACCCGCGACGGCGGCAAGAACGACACGGACACCTTCAGGCCAGAGGGAGGCAACATGAAGGACAACTGGCGCTCCGAGC
TGTACAAGTACAAGGTGGTGGAGGTGAAGCCCCTGGGCGTGGCACCCACCAACGCCCGCAGGCGCGTCGTGGAGCGCGA
GAAGCGCGCCGTGGGCATGGGCGCCGTGTTCCTGGGCTTCCTGGGCGCTGCGGGCTCCACCATGGGTGCCGCGTCCATC
ACCCTGACCGTGCAGGCCCGCCAGCTGCTCTCCGGCATCGTGCAGCAGCAGTCCAACCTCCTGAAGGCCATCGAGGCCC
AGCAGCACATGCTGAAGCTGACCGTGTGGGGCATCAAGCAGCTGCAGGCCAGGGTGCTCGCGCTCGAGCGCTACCTGAA
GGACCAGCAGCTGCTCGGCATGTGGGGCTGCTCCGGCAAGCTGATCTGCACCACCAACGTGTACTGGAACTCGTCCTGG
TCCAACAAGACCTACGGCGACATCTGGGACAACATGACCTGGATGCAGTGGGAGCGCGAGATCTCCAACTACACCGAGC
TGATCTACGAGCTCCTCGAGGAGTCCCAGAACCAGCAGGAGAAGAACGAGCAGGATCTGCTCGCGCTGGACCGCTGGAA
CTCCCTGTGGAACTGGTTCAACATCACCAACTGGCTGTGGTACATCAAGATCTTCATCATGATCGTGGGCGGCCTGATC
GGCCTGCGCATCATCTTCGCCGTGCTGTCGCTGGTGAACCGCGTGCGCCAGGGCTGATGAGaattcggtcaccgggtcc
tggatcc

Figure 1 cont.

>HV1300638, CH505w053.31gp145 (SEQ ID NO. 30)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCATGTGGGTGACGGTGTACTACGGCGTGCCGGTGTGGAAGGAGGCCAAGACGACC
CTGTTCTGCGCGTCGGACGCCAAGGCCTACGAGAAGGAGGTGCACAACGTGTGGGCGACCCACGCCTGCGTGCCCACGG
ACCCCAACCCGCAGGAGATGGTGCTGAAGAACGTGACCGAGAACTTCAACATGTGGAAGAACGACATGGTGGACCAGAT
GCACGAGGACGTGATCTCCCTGTGGGACCAGTCCCTGAAGCCCTGCGTGAAGCTGACCCCGCTGTGCGTGACCCTGAAC
TGCACCGACGCCACCGCGTCCAACGCAACCGCGAGCAACGCCACGGCGTCGAACTCCTCCATCATCGAGGGCATGAAGA
ACTGCTCCTTCAACATCACGACGGAGCTGCGCGACAAGCGCGAGAAGAAGAACGCCCTGTTCTACAAGCTGGACATCGT
GCAGCTGGACGGCAACTCCTCGCAGTACAGGCTGATCAACTGCAACACCTCCGTCATCACGCAGGCGTGCCCCAAGGTG
TCCTTCGACCCCATCCCCATCCACTACTGCGCCCCCGCCGGCTACGCCATCCTGAAGTGCAACAACAAGACCTTCAACG
GCACCGGCCCGTGCAACAACGTGTCCACCGTGCAGTGCACGCACGGGATCAAGCCCGTGGTGTCCACGCAGCTGCTCCT
GAACGGGTCGCTGGCCGAGGGCGAGATCATCATCCGGTCCGAGAACATCACGGACAACGGGAAGACCATCATCGTGCAC
CTGAACGAGTCCGTGAAGATCGAGTGCACCCGCCCGTCGAACAACACGCGCACCTCCATCCGGATCGGCCCTGGCCAGG
CCTTCTACGCCACCGGCCAGGTGATCGGCGACATCCGCGAGGCGCACTGCAACATCTCGGAGTCCAAGTGGAACGAGAC
CCTGCAGCGCGTGTCCAAGAAGCTGAAGGAGTACTTCCCCCACAAGAACATCACCTTCCAGCCGTCGTCCGGCGGCGAC
CTCGAGATCACCACGCACTCCTTCAACTGCGGTGGCGAGTTCTTCTACTGCAACACGTCGTCGCTGTTCAACCGCACCT
ACATGGCCAACTCCACCGAGACCAACTCCACGCGCATCATCACGATCCGCTGCCGCATCAAGCAGATCATCAACATGTG
GCAGGAGGTGGGCCGCGCCATGTACGCACCGCCCATCGCCGGCAACATCACCTGCATCTCCAACATCACCGGCCTCCTG
CTGACCCGCGACGGCGGCAACAACAACACGGAGACCTTCAGGCCAGGCGGAGGCAACATGAAGGACAACTGGCGCTCCG
AGCTGTACAAGTACAAGGTGGTGGAGGTGAAGCCCCTGGGCGTGGCACCCACCAACGCCCGCAGGCGCGTCGTGGAGCG
CGAGAAGCGCGCCGTGGGCATGGGCGCCGTGTTCCTGGGCTTCCTGGGCGCTGCGGGCTCCACCATGGGTGCCGCGTCC
ATCACCCTGACCGTGCAGGCCCGCCAGCTGCTCTCCGGCATCGTGCAGCAGCAGTCCAACCTCCTGAAGGCCATCGGGG
CCCAGCAGCACATGCTGAAGCTGACCGTGTGGGGCATCAAGCAGCTGCAGGCCAGGGTGCTCGCGCTCGAGCGCTACCT
GAAGGACCAGCAGCTGCTCGGCATGTGGGGCTGCTCCGGCAAGCTGATCTGCACCACCAACGTGTACTGGAACTCGTCC
TGGTCCAACAAGACCTACGGCGACATCTGGGACAACATGACCTGGATGCAGTGGGAGCGCGAGATCTCCAACTACACCG
AGATGATCTACGAGCTCCTCGAGGAGTCCCAGAACCAGCAGGAGAAGAACGAGCAGGATCTGCTCGCGCTGGACCGCTG
GAACTCCCTGTGGAACTGGTTCAACATCACCAACTGGCTGTGGTACATCAAGATCTTCATCATGATCGTGGGCGGCCTG
ATCGGCCTGCGCATCATCTTCGCCGTGCTGTCGCTGGTGAACCGCGTGCGCCAGGGCTGATGAGaattcggtgaccggg
acctggatcc

Figure 1 cont.

>HV1300656, CH505.M5gp145 (SEQ ID NO. 31)

MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKLTPLCVTLNCTNATASNSSIIEGMKNCSFNITTELRDKREK
KNALFYKLDIVQLDGNSSQYRLINCNTSVITQACPKVSFDPIPIHYCAPAGYAILKCNNKTFTGTGPCNNVSTVQCTHG
IKPVVSTQLLLNGSLAEGEIIIRSENITKNVKTIIVHLNESVKIECTRPNNKTRTSIRIGPGQAFYATGQVIGDIREAY
CNINESKWNETLQRVSKKLKEYFPHKNITFQPSSGGDLEITTHSFNCGGEFFYCNTSSLFNRTYMANSTDMANSTETNS
TRTITIHCRIKQIINMWQEVGRAMYAPPIAGNITCISNITGLLLTRDGGKNNTETFRPGGGNMKDNWRSELYKYKVVEV
KPLGVAPTNARRRVVEREKRAVGMGAVFLGFLGAAGSTMGAASITLTVQARQLLSGIVQQQSNLLKAIEAQQHMLKLTV
WGIKQLQARVLALERYLKDQQLLGMWGCSGKLICTTNVYWNSSWSNKTYGDIWDNMTWMQWEREISNYTEIIYELLEES
QNQQEKNEQDLLALDRWNSLWNWFNITNWLWYIKIFIMIVGGLIGLRIIFAVLSLVNRVRQG*

>HV1300662, CH505.M11gp145 (SEQ ID NO. 32)

MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKLTPLCVTLNCTNATASNSSIIEGMKNCSFNITTELRDKREK
KNALFYKLDIVQLDGNSSQYRLINCNTSVITQACPKVSFDPIPIHYCAPAGYAILKCNNKTFTGTGPCNNVSTVQCTHG
IKPVVSTQLLLNGSLAEGEIIIRSENITDNGKTIIVHLNESVKIECTRPNNKTRTSIRIGPGQAFYATGQVIGDIREAY
CNINESKWNETLQRVSKKLKEYFPHKNITFQPSSGGDLEITTHSFNCGGEFFYCNTSSLFNRTYMANSTDMANSTETNS
TRTITIHCRIKQIINMWQEVGRAMYAPPIAGNITCISNITGLLLTRDGGKNNTETFRPGGGNMKDNWRSELYKYKVVEV
KPLGVAPTNARRRVVEREKRAVGMGAVFLGFLGAAGSTMGAASITLTVQARQLLSGIVQQQSNLLKAIEAQQHMLKLTV
WGIKQLQARVLALERYLKDQQLLGMWGCSGKLICTTNVYWNSSWSNKTYGDIWDNMTWMQWEREISNYTEIIYELLEES
QNQQEKNEQDLLALDRWNSLWNWFNITNWLWYIKIFIMIVGGLIGLRIIFAVLSLVNRVRQG*

>HV1300635, CH505w020.14gp145 (SEQ ID NO. 33)

MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKLTPLCVTLNCTNATASNNSIIEGMKNCSFNITTELRDKREK
KNALFYKLDIVQLDGNSSQYRLINCNTSVITQACPKVSFDPIPIHYCAPAGYAILKCNNKTFTGTGPCNNVSTVQCTHG
IKPVVSTQLLLNGSLAEGEIIIRSENITNNAKTIIVHLNESVKIECTRPNNKTRTSIRIGPGQAFYATGQVIGDIRKAY
CNISESKWNETLQRVSKKLKEYFPHKNITFQPSSGGDLEITTHSFNCGGEFFYCNTSSLFNRTYMANSTDMANSTETNS
TRTITLHCRIKQIINMWQEVGRAMYAPPIAGNITCISNITGLLLTRDGGKNNTETFRPGGGNMKDNWRSELYKYKVVEV
KPLGVAPTNARRRVVEREKRAVGMGAVFLGFLGAAGSTMGAASITLTVQARQLLSGIVQQQSNLLKAIEAQQHMLKLTV
WGIKQLQARVLALERYLKDQQLLGMWGCSGKLICTTNVYWNSSWSNKTYGDIWDNMTWMQWEREISNYTEIIYELLEES
QNQQEKNEQDLLALDRWNSLWNWFNITNWLWYIKIFIMIVGGLIGLRIIFAVLSLVNRVRQG*

Figure 1 cont.

>HV1300636, CH505w030.28gp145 (SEQ ID NO. 34)

MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKMTPLCVTLNCTNATAINSSIIEGMKNCSFNITTELRDKREK
KNALFYKLDIVQLDGNSSQYRLINCNTSVITQACPKVSFDPIPIHYCAPAGYAILKCNNKTFTGTGPCNNVSTVQCTHG
IKPVVSTQLLLNGSLAEGEIIIRSENITNNDKTIIVHLNESVKIECTRPNNKTRTSIRIGPGQAFYATGQVIGDIREAH
CNISESKWNETLQRVSKKLKEYFPHKNITFQPSSGGDLEITTHSFNCGGEFFYCNTSSLFNRTYMANSTDMANSTETNS
TRTITIRCRIKQIINMWQEVGRAMYAPPIAGNITCISNITGLLLTRDGGKNNTETFRPGGGNMKDNWRSELYKYKVVEV
KPLGVAPTNARRRVVEREKRAVGMGAVFLGFLGAAGSTMGAASITLTVQARQLLSGIVQQQSNLLKAIEAQQHMLKLTV
WGIKQLQARVLALERYLKDQQLLGMWGCSGKLICTTNVYWNSSWSNKSYGDIWDNMTWMQWEREISNYTEIIYELLEES
QNQQEKNEQDLLALDRWNSLWNWFNITNWLWYIKIFIMIVGGLIGLRIIFAVLSLVNRVRQG*

>HV1300638, CH505w053.31gp145 (SEQ ID NO. 35)

MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKLTPLCVTLNCTDATASNATASNATASNSSIIEGMKNCSFNI
TTELRDKREKKNALFYKLDIVQLDGNSSQYRLINCNTSVITQACPKVSFDPIPIHYCAPAGYAILKCNNKTFNGTGPCN
NVSTVQCTHGIKPVVSTQLLLNGSLAEGEIIIRSENITDNGKTIIVHLNESVKIECTRPSNNTRTSIRIGPGQAFYATG
QVIGDIREAHCNISESKWNETLQRVSKKLKEYFPHKNITFQPSSGGDLEITTHSFNCGGEFFYCNTSSLFNRTYMANST
ETNSTRIITIRCRIKQIINMWQEVGRAMYAPPIAGNITCISNITGLLLTRDGGNNNTETFRPGGGNMKDNWRSELYKYK
VVEVKPLGVAPTNARRRVVEREKRAVGMGAVFLGFLGAAGSTMGAASITLTVQARQLLSGIVQQQSNLLKAIGAQQHML
KLTVWGIKQLQARVLALERYLKDQQLLGMWGCSGKLICTTNVYWNSSWSNKTYGDIWDNMTWMQWEREISNYTEMIYEL
LEESQNQQEKNEQDLLALDRWNSLWNWFNITNWLWYIKIFIMIVGGLIGLRIIFAVLSLVNRVRQG*

>HV1300639, CH505w078.15gp145 (SEQ ID NO. 36)

MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKLTPLCVTLSCTNATNATASNSSILEGMKNCSFNITTELRDK
REKKNALFYKLDIVQLDGNSSQYRLINCNTSVITQACPKVSFDPIPIHYCAPAGYAILKCNNKTFNGTGPCNNVSTVQC
THGIKPVVSTQLLLNGSLAEGEIIIRSKNITDNGKTIIVHLNESVKIECTRPSNNTRTSIRIGPGQAFYATGQVIGDIR
EAHCNISESKWNETLQRVSEKLKEYFPHKNITFQPSSGGDLEITTHSFNCGGEFFYCNTSSLFNRTYMATSTDMANSTE
TNSTRIITIRCRIKQIINMWQEVGRAMYAPPIAGNITCISNITGLLLTRDGGKNDTDTFRPEGGNMKDNWRSELYKYKV
VEVKPLGVAPTNARRRVVEREKRAVGMGAVFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNKTYGDIWDNMTWMQWEREISNYTELIYELL
EESQNQQEKNEQDLLALDRWNSLWNWFNITNWLWYIKIFIMIVGGLIGLRIIFAVLSLVNRVRQG*

Figure 1 cont.

>HV1300638, CH505w053.31gp145 (SEQ ID NO. 37)

MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKLTPLCVTLNCTDATASNATASNATASNSSIIEGMKNCSFNI
TTELRDKREKKNALFYKLDIVQLDGNSSQYRLINCNTSVITQACPKVSFDPIPIHYCAPAGYAILKCNNKTFNGTGPCN
NVSTVQCTHGIKPVVSTQLLLNGSLAEGEIIIRSENITDNGKTIIVHLNESVKIECTRPSNNTRTSIRIGPGQAFYATG
QVIGDIREAHCNISESKWNETLQRVSKKLKEYFPHKNITFQPSSGGDLEITTHSFNCGGEFFYCNTSSLFNRTYMANST
ETNSTRIITIRCRIKQIINMWQEVGRAMYAPPIAGNITCISNITGLLLTRDGGNNNTETFRPGGGNMKDNWRSELYKYK
VVEVKPLGVAPTNARRRVVEREKRAVGMGAVFLGFLGAAGSTMGAASITLTVQARQLLSGIVQQQSNLLKAIGAQQHML
KLTVWGIKQLQARVLALERYLKDQQLLGMWGCSGKLICTTNVYWNSSWSNKTYGDIWDNMTWMQWEREISNYTEMIYEL
LEESQNQQEKNEQDLLALDRWNSLWNWFNITNWLWYIKIFIMIVGGLIGLRIIFAVLSLVNRVRQG*

| Env name | Plasmid ID | Bar code |
|---|---|---|
| CH505.M5D8gp120 | HV1300531_v2 | **TAGTAAG**gtgaccgaattcgggacccggatcc(SEQ ID NO 38) |
| CH505.M11D8gp120 | HV1300537_v2 | **TAGTAAG**gtgaccgaattcaggtcccggatcc(SEQ ID NO 39) |
| CH505w020.14D8gp120 | HV1300556_v2 | **TAGTAAG**ggacccgaattcggtcaccggatcc(SEQ ID NO 40) |
| CH505w030.28D8gp120 | HV1300578_v2 | **TAGTAAG**ggtcctgaattcggttaccggatcc(SEQ ID NO 41) |
| CH505w078.15D8gp120 | HV1300592 | **TAGTAAG**aattcggtcaccgggtcctggatcc(SEQ ID NO 42) |
| CH505w053.31D8gp120 | HV1300586 | **TAGTAAG**aattcggtgaccgggacctggatcc(SEQ ID NO 43) |

Figure 1 cont.

>HV1300531_v2, CH505.M5D8gp120 (SEQ ID NO. 44)
gtcgacaagaagccaccATGCGCGTGATGGGCATCCAGCGCAACTACCCGCAGTGGTGGATCTGGTCGATGCTGGGCTT
CTGGATGCTCATGATCTGCAACGGCGTGCCGGTGTGGAAGGAGGCCAAGACGACCCTGTTCTGCGCGTCGGACGCCAAG
GCCTACGAGAAGGAGGTGCACAACGTGTGGGCGACCCACGCCTGCGTGCCCACGGACCCCAACCCGCAGGAGATGGTGC
TGAAGAACGTGACCGAGAACTTCAACATGTGGAAGAACGACATGGTGGACCAGATGCACGAGGACGTGATCTCCCTGTG
GGACCAGTCCCTGAAGCCCTGCGTGAAGCTGACCCCGCTGTGCGTGACCCTGAACTGCACCAACGCCACCGCGTCCAAC
TCCTCCATCATCGAGGGCATGAAGAACTGCTCCTTCAACATCACGACGGAGCTGCGCGACAAGCGCGAGAAGAAGAACG
CCCTGTTCTACAAGCTGGACATCGTGCAGCTGGACGGCAACTCCTCGCAGTACAGGCTGATCAACTGCAACACCTCCGT
CATCACGCAGGCGTGCCCCAAGGTGTCCTTCGACCCCATCCCCATCCACTACTGCGCCCCCGCCGGCTACGCCATCCTG
AAGTGCAACAACAAGACCTTCACCGGCACCGGCCCGTGCAACAACGTGTCCACCGTGCAGTGCACGCACGGGATCAAGC
CCGTGGTGTCCACGCAGCTGCTCCTGAACGGGTCGCTGGCCGAGGGCGAGATCATCATCCGGTCCGAGAACATCACGAA
GAACGTGAAGACCATCATCGTGCACCTGAACGAGTCCGTGAAGATCGAGTGCACCCGCCCGAACAACAAGACGCGCACC
TCCATCCGGATCGGCCCTGGCCAGGCCTTCTACGCCACCGGCCAGGTGATCGGCGACATCCGCGAGGCGTACTGCAACA
TCAACGAGTCCAAGTGGAACGAGACCCTGCAGCGCGTGTCCAAGAAGCTGAAGGAGTACTTCCCCCACAAGAACATCAC
CTTCCAGCCGTCGTCCGGCGGCGACCTCGAGATCACCACGCACTCCTTCAACTGCGGTGGCGAGTTCTTCTACTGCAAC
ACGTCGTCGCTGTTCAACCGCACCTACATGGCCAACTCCACCGACATGGCCAACTCCACCGAGACCAACTCCACGCGCA
CCATCACGATCCACTGCCGCATCAAGCAGATCATCAACATGTGGCAGGAGGTGGGCCGCGCCATGTACGCACCGCCCAT
CGCCGGCAACATCACCTGCATCTCCAACATCACCGGCCTCCTGCTGACCCGCGACGGCGGCAAGAACAACACGGAGACC
TTCAGGCCAGGCGGAGGCAACATGAAGGACAACTGGCGCTCCGAGCTGTACAAGTACAAGGTGGTGGAGGTGAAGCCCC
TGGGCGTGGCACCCACCAACGCCCGCGAGCGCGTCGTGGAGCGCGAGAAGGAGTAGTAAGgtgaccgaattcgggaccc
ggatcc

Figure 1 cont.

>HV1300537_v2, CH505.M11D8gp120 (SEQ ID NO. 45)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCGTGCCGGTGTGGAAGGAGGCCAAGACGACCCTGTTCTGCGCGTCGGACGCCAAG
GCCTACGAGAAGGAGGTGCACAACGTGTGGGCGACCCACGCCTGCGTGCCCACGGACCCCAACCCGCAGGAGATGGTGC
TGAAGAACGTGACCGAGAACTTCAACATGTGGAAGAACGACATGGTGGACCAGATGCACGAGGACGTGATCTCCCTGTG
GGACCAGTCCCTGAAGCCCTGCGTGAAGCTGACCCCGCTGTGCGTGACCCTGAACTGCACCAACGCCACCGCGTCCAAC
TCCTCCATCATCGAGGGCATGAAGAACTGCTCCTTCAACATCACGACGGAGCTGCGCGACAAGCGCGAGAAGAAGAACG
CCCTGTTCTACAAGCTGGACATCGTGCAGCTGGACGGCAACTCCTCGCAGTACAGGCTGATCAACTGCAACACCTCCGT
CATCACGCAGGCGTGCCCCAAGGTGTCCTTCGACCCCATCCCCATCCACTACTGCGCCCCCGCCGGCTACGCCATCCTG
AAGTGCAACAACAAGACCTTCACCGGCACCGGCCCGTGCAACAACGTGTCCACCGTGCAGTGCACGCACGGGATCAAGC
CCGTGGTGTCCACGCAGCTGCTCCTGAACGGGTCGCTGGCCGAGGGCGAGATCATCATCCGGTCCGAGAACATCACGGA
CAACGGGAAGACCATCATCGTGCACCTGAACGAGTCCGTGAAGATCGAGTGCACCCGCCCGAACAACAAGACGCGCACC
TCCATCCGGATCGGCCCTGGCCAGGCCTTCTACGCCACCGGCCAGGTGATCGGCGACATCCGCGAGGCGTACTGCAACA
TCAACGAGTCCAAGTGGAACGAGACCCTGCAGCGCGTGTCCAAGAAGCTGAAGGAGTACTTCCCCCACAAGAACATCAC
CTTCCAGCCGTCGTCCGGCGGCGACCTCGAGATCACCACGCACTCCTTCAACTGCGGTGGCGAGTTCTTCTACTGCAAC
ACGTCGTCGCTGTTCAACCGCACCTACATGGCCAACTCCACCGACATGGCCAACTCCACCGAGACCAACTCCACGCGCA
CCATCACGATCCACTGCCGCATCAAGCAGATCATCAACATGTGGCAGGAGGTGGGCCGCGCCATGTACGCACCGCCCAT
CGCCGGCAACATCACCTGCATCTCCAACATCACCGGCCTCCTGCTGACCCGCGACGGCGGCAAGAACAACACGGAGACC
TTCAGGCCAGGCGGAGGCAACATGAAGGACAACTGGCGCTCCGAGCTGTACAAGTACAAGGTGGTGGAGGTGAAGCCCC
TGGGCGTGGCACCCACCAACGCCCGCGAGCGCGTCGTGGAGCGCGAGAAGGAGTAGTAAGgtgaccgaattcaggtccc
ggatcc

Figure 1 cont.

>HV1300556_v2, CH505w020.14D8gp120 (SEQ ID NO. 46)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCGTGCCGGTGTGGAAGGAGGCCAAGACGACCCTGTTCTGCGCGTCGGACGCCAAG
GCCTACGAGAAGGAGGTGCACAACGTGTGGGCGACCCACGCCTGCGTGCCCACGGACCCCAACCCGCAGGAGATGGTGC
TGAAGAACGTGACCGAGAACTTCAACATGTGGAAGAACGACATGGTGGACCAGATGCACGAGGACGTGATCTCCCTGTG
GGACCAGTCCCTGAAGCCCTGCGTGAAGCTGACCCCGCTGTGCGTGACCCTGAACTGCACCAACGCCACCGCGTCCAAC
AACTCCATCATCGAGGGCATGAAGAACTGCTCCTTCAACATCACGACGGAGCTGCGCGACAAGCGCGAGAAGAAGAACG
CCCTGTTCTACAAGCTGGACATCGTGCAGCTGGACGGCAACTCCTCGCAGTACAGGCTGATCAACTGCAACACCTCCGT
CATCACGCAGGCGTGCCCCAAGGTGTCCTTCGACCCCATCCCCATCCACTACTGCGCCCCCGCCGGCTACGCCATCCTG
AAGTGCAACAACAAGACCTTCACCGGCACCGGCCCGTGCAACAACGTGTCCACCGTGCAGTGCACGCACGGGATCAAGC
CCGTGGTGTCCACGCAGCTGCTCCTGAACGGGTCGCTGGCCGAGGGCGAGATCATCATCCGGTCCGAGAACATCACGAA
CAACGCGAAGACCATCATCGTGCACCTGAACGAGTCCGTGAAGATCGAGTGCACCCGCCCGAACAACAAGACGCGCACG
TCCATCCGGATCGGCCCTGGCCAGGCCTTCTACGCCACCGGCCAGGTGATCGGCGACATCCGCAAGGCGTACTGCAACA
TCTCGGAGTCCAAGTGGAACGAGACCCTGCAGCGCGTGTCCAAGAAGCTGAAGGAGTACTTCCCCCACAAGAACATCAC
CTTCCAGCCGTCGTCCGGCGGCGACCTCGAGATCACCACGCACTCCTTCAACTGCGGTGGCGAGTTCTTCTACTGCAAC
ACGTCGTCGCTGTTCAACCGCACCTACATGGCCAACTCCACCGACATGGCCAACTCCACCGAGACCAACTCCACGCGCA
CCATCACGCTCCACTGCCGCATCAAGCAGATCATCAACATGTGGCAGGAGGTGGGCCGCGCCATGTACGCACCGCCCAT
CGCCGGCAACATCACCTGCATCTCCAACATCACCGGCCTCCTGCTGACCCGCGACGGCGGCAAGAACAACACGGAGACC
TTCAGGCCAGGCGGAGGCAACATGAAGGACAACTGGCGCTCCGAGCTGTACAAGTACAAGGTGGTGGAGGTGAAGCCCC
TGGGCGTGGCACCCACCAACGCCCGCGAGCGCGTCGTGGAGCGCGAGAAGGAGTAGTAAGggacccgaattcggtcacc
ggatcc

Figure 1 cont.

>HV1300578_v2, CH505w030.28D8gp120 (SEQ ID NO. 47)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCGTGCCGGTGTGGAAGGAGGCCAAGACGACCCTGTTCTGCGCGTCGGACGCCAAG
GCCTACGAGAAGGAGGTGCACAACGTGTGGGCGACCCACGCCTGCGTGCCCACGGACCCCAACCCGCAGGAGATGGTGC
TGAAGAACGTGACCGAGAACTTCAACATGTGGAAGAACGACATGGTGGACCAGATGCACGAGGACGTGATCTCCCTGTG
GGACCAGTCCCTGAAGCCCTGCGTGAAGATGACCCCGCTGTGCGTGACCCTGAACTGCACCAACGCCACCGCGATCAAC
TCCTCCATCATCGAGGGCATGAAGAACTGCTCCTTCAACATCACGACGGAGCTGCGCGACAAGCGCGAGAAGAAGAACG
CCCTGTTCTACAAGCTGGACATCGTGCAGCTGGACGGCAACTCCTCGCAGTACAGGCTGATCAACTGCAACACCTCCGT
CATCACGCAGGCGTGCCCCAAGGTGTCCTTCGACCCCATCCCCATCCACTACTGCGCCCCCGCCGGCTACGCCATCCTG
AAGTGCAACAACAAGACCTTCACCGGCACCGGCCCGTGCAACAACGTGTCCACCGTGCAGTGCACGCACGGGATCAAGC
CCGTGGTGTCCACGCAGCTGCTCCTGAACGGGTCGCTGGCCGAGGGCGAGATCATCATCCGGTCCGAGAACATCACGAA
CAACGACAAGACCATCATCGTGCACCTGAACGAGTCCGTGAAGATCGAGTGCACCCGCCCGAACAACAAGACGCGCACC
TCCATCCGGATCGGCCCTGGCCAGGCCTTCTACGCCACCGGCCAGGTGATCGGCGACATCCGCGAGGCGCACTGCAACA
TCTCGGAGTCCAAGTGGAACGAGACCCTGCAGCGCGTGTCCAAGAAGCTGAAGGAGTACTTCCCCCACAAGAACATCAC
CTTCCAGCCGTCGTCCGGCGGCGACCTCGAGATCACCACGCACTCCTTCAACTGCGGTGGCGAGTTCTTCTACTGCAAC
ACGTCGTCGCTGTTCAACCGCACCTACATGGCCAACTCCACCGACATGGCCAACTCCACCGAGACCAACTCCACGCGCA
CCATCACGATCCGCTGCCGCATCAAGCAGATCATCAACATGTGGCAGGAGGTGGGCCGCGCCATGTACGCACCGCCCAT
CGCCGGCAACATCACCTGCATCTCCAACATCACCGGCCTCCTGCTGACCCGCGACGGCGGCAAGAACAACACGGAGACC
TTCAGGCCAGGCGGAGGCAACATGAAGGACAACTGGCGCTCCGAGCTGTACAAGTACAAGGTGGTGGAGGTGAAGCCCC
TGGGCGTGGCACCCACCAACGCCCGCGAGCGCGTCGTGGAGCGCGAGAAGGAGTAGTAAGggtcctgaattcggttacc
ggatcc

Figure 1 cont.

>HV1300592, CH505w078.15D8gp120 (SEQ ID NO. 48)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCGTGCCGGTGTGGAAGGAGGCCAAGACGACCCTGTTCTGCGCGTCGGACGCCAAG
GCCTACGAGAAGGAGGTGCACAACGTGTGGGCGACCCACGCCTGCGTGCCCACGGACCCCAACCCGCAGGAGATGGTGC
TGAAGAACGTGACCGAGAACTTCAACATGTGGAAGAACGACATGGTGGACCAGATGCACGAGGACGTGATCTCCCTGTG
GGACCAGTCCCTGAAGCCCTGCGTGAAGCTGACCCCGCTGTGCGTGACCCTGAGCTGCACGAACGCCACCAACGCGACG
GCGTCGAACTCGTCCATCCTCGAGGGGATGAAGAACTGCTCCTTCAACATCACGACGGAGCTGCGCGACAAGCGCGAGA
AGAAGAACGCCCTGTTCTACAAGCTGGACATCGTGCAGCTGGACGGCAACTCCTCGCAGTACAGGCTGATCAACTGCAA
CACCTCCGTCATCACGCAGGCGTGCCCCAAGGTGTCCTTCGACCCCATCCCCATCCACTACTGCGCCCCCGCCGGCTAC
GCCATCCTGAAGTGCAACAACAAGACCTTCAACGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCGAAGAA
CATCACGGACAACGGGAAGACCATCATCGTGCACCTGAACGAGTCCGTGAAGATCGAGTGCACCCGCCCGAGCAACAAC
ACGCGCACCTCCATCCGGATCGGCCCTGGCCAGGCCTTCTACGCCACCGGCCAGGTGATCGGCGACATCCGCGAGGCGC
ACTGCAACATCTCCGAGTCCAAGTGGAACGAGACCCTGCAGCGCGTGTCCGAGAAGCTGAAGGAGTACTTCCCCCACAA
GAACATCACCTTCCAGCCGTCGTCCGGCGGCGACCTCGAGATCACCACGCACTCCTTCAACTGCGGTGGCGAGTTCTTC
TACTGCAACACGTCGTCGCTGTTCAACCGCACCTACATGGCCACCTCCACCGACATGGCCAACTCCACCGAGACCAACT
CCACGCGCATCATCACGATCCGCTGCCGCATCAAGCAGATCATCAACATGTGGCAGGAGGTGGGCCGCGCCATGTACGC
ACCGCCCATCGCCGGCAACATCACCTGCATCTCCAACATCACCGGCCTCCTGCTGACCCGCGACGGCGGCAAGAACGAC
ACGGACACCTTCAGGCCAGAGGGAGGCAACATGAAGGACAACTGGCGCTCCGAGCTGTACAAGTACAAGGTGGTGGAGG
TGAAGCCCCTGGGCGTGGCACCCACCAACGCCCGCGAGCGCGTCGTGGAGCGCGAGAAGGAGTAGTAAGaattcggtca
ccgggtcctggatcc

Figure 1 cont.

>HV1300586, CH505w053.31D8gp120 (SEQ ID NO. 49)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCGTGCCGGTGTGGAAGGAGGCCAAGACGACCCTGTTCTGCGCGTCGGACGCCAAG
GCCTACGAGAAGGAGGTGCACAACGTGTGGGCGACCCACGCCTGCGTGCCCACGGACCCCAACCCGCAGGAGATGGTGC
TGAAGAACGTGACCGAGAACTTCAACATGTGGAAGAACGACATGGTGGACCAGATGCACGAGGACGTGATCTCCCTGTG
GGACCAGTCCCTGAAGCCCTGCGTGAAGCTGACCCCGCTGTGCGTGACCCTGAACTGCACCGACGCCACCGCGTCCAAC
GCAACCGCGAGCAACGCCACGGCGTCGAACTCCTCCATCATCGAGGGCATGAAGAACTGCTCCTTCAACATCACGACGG
AGCTGCGCGACAAGCGCGAGAAGAAGAACGCCCTGTTCTACAAGCTGGACATCGTGCAGCTGGACGGCAACTCCTCGCA
GTACAGGCTGATCAACTGCAACACCTCCGTCATCACGCAGGCGTGCCCCAAGGTGTCCTTCGACCCCATCCCCATCCAC
TACTGCGCCCCCGCCGGCTACGCCATCCTGAAGTGCAACAACAAGACCTTCAACGGCACCGGCCCGTGCAACAACGTGT
CCACCGTGCAGTGCACGCACGGGATCAAGCCCGTGGTGTCCACGCAGCTGCTCCTGAACGGGTCGCTGGCCGAGGGCGA
GATCATCATCCGGTCCGAGAACATCACGGACAACGGGAAGACCATCATCGTGCACCTGAACGAGTCCGTGAAGATCGAG
TGCACCCGCCCGTCGAACAACACGCGCACCTCCATCCGGATCGGCCCTGGCCAGGCCTTCTACGCCACCGGCCAGGTGA
TCGGCGACATCCGCGAGGCGCACTGCAACATCTCGGAGTCCAAGTGGAACGAGACCCTGCAGCGCGTGTCCAAGAAGCT
GAAGGAGTACTTCCCCCACAAGAACATCACCTTCCAGCCGTCGTCCGGCGGCGACCTCGAGATCACCACGCACTCCTTC
AACTGCGGTGGCGAGTTCTTCTACTGCAACACGTCGTCGCTGTTCAACCGCACCTACATGGCCAACTCCACCGAGACCA
ACTCCACGCGCATCATCACGATCCGCTGCCGCATCAAGCAGATCATCAACATGTGGCAGGAGGTGGGCCGCGCCATGTA
CGCACCGCCCATCGCCGGCAACATCACCTGCATCTCCAACATCACCGGCCTCCTGCTGACCCGCGACGGCGGCAACAAC
AACACGGAGACCTTCAGGCCAGGCGGAGGCAACATGAAGGACAACTGGCGCTCCGAGCTGTACAAGTACAAGGTGGTGG
AGGTGAAGCCCCTGGGCGTGGCACCCACCAACGCCCGCGAGCGCGTCGTGGAGCGCGAGAAGGAGTAGTAAGaattcgg
tgaccgggacctggatcc

Figure 1 cont.

>HV1300531_v2, CH505.M5D8gp120 (SEQ ID NO. 50)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLNCTNATASNSSIIEGMKNCSFNITTELRDKREKKNALFYKL
DIVQLDGNSSQYRLINCNTSVITQACPKVSFDPIPIHYCAPAGYAILKCNNKTFTGTGPCNNVSTVQCTHGIKPVVSTQ
LLLNGSLAEGEIIIRSENITKNVKTIIVHLNESVKIECTRPNNKTRTSIRIGPGQAFYATGQVIGDIREAYCNINESKW
NETLQRVSKKLKEYFPHKNITFQPSSGGDLEITTHSFNCGGEFFYCNTSSLFNRTYMANSTDMANSTETNSTRTITIHC
RIKQIINMWQEVGRAMYAPPIAGNITCISNITGLLLTRDGGKNNTETFRPGGGNMKDNWRSELYKYKVVEVKPLGVAPT
NARERVVEREKE*

>HV1300537_v2, CH505.M11D8gp120 (SEQ ID NO. 51)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLNCTNATASNSSIIEGMKNCSFNITTELRDKREKKNALFYKL
DIVQLDGNSSQYRLINCNTSVITQACPKVSFDPIPIHYCAPAGYAILKCNNKTFTGTGPCNNVSTVQCTHGIKPVVSTQ
LLLNGSLAEGEIIIRSENITDNGKTIIVHLNESVKIECTRPNNKTRTSIRIGPGQAFYATGQVIGDIREAYCNINESKW
NETLQRVSKKLKEYFPHKNITFQPSSGGDLEITTHSFNCGGEFFYCNTSSLFNRTYMANSTDMANSTETNSTRTITIHC
RIKQIINMWQEVGRAMYAPPIAGNITCISNITGLLLTRDGGKNNTETFRPGGGNMKDNWRSELYKYKVVEVKPLGVAPT
NARERVVEREKE*

>HV1300556_v2, CH505w020.14D8gp120 (SEQ ID NO. 52)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLNCTNATASNNSIIEGMKNCSFNITTELRDKREKKNALFYKL
DIVQLDGNSSQYRLINCNTSVITQACPKVSFDPIPIHYCAPAGYAILKCNNKTFTGTGPCNNVSTVQCTHGIKPVVSTQ
LLLNGSLAEGEIIIRSENITNNAKTIIVHLNESVKIECTRPNNKTRTSIRIGPGQAFYATGQVIGDIRKAYCNISESKW
NETLQRVSKKLKEYFPHKNITFQPSSGGDLEITTHSFNCGGEFFYCNTSSLFNRTYMANSTDMANSTETNSTRTITLHC
RIKQIINMWQEVGRAMYAPPIAGNITCISNITGLLLTRDGGKNNTETFRPGGGNMKDNWRSELYKYKVVEVKPLGVAPT
NARERVVEREKE*

>HV1300578_v2, CH505w030.28D8gp120 (SEQ ID NO. 53)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKMTPLCVTLNCTNATAINSSIIEGMKNCSFNITTELRDKREKKNALFYKL
DIVQLDGNSSQYRLINCNTSVITQACPKVSFDPIPIHYCAPAGYAILKCNNKTFTGTGPCNNVSTVQCTHGIKPVVSTQ
LLLNGSLAEGEIIIRSENITNNDKTIIVHLNESVKIECTRPNNKTRTSIRIGPGQAFYATGQVIGDIREAHCNISESKW
NETLQRVSKKLKEYFPHKNITFQPSSGGDLEITTHSFNCGGEFFYCNTSSLFNRTYMANSTDMANSTETNSTRTITIRC
RIKQIINMWQEVGRAMYAPPIAGNITCISNITGLLLTRDGGKNNTETFRPGGGNMKDNWRSELYKYKVVEVKPLGVAPT
NARERVVEREKE*

Figure 1 cont.

>HV1300592, CH505w078.15D8gp120 (SEQ ID NO. 54)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLSCTNATNATASNSSILEGMKNCSFNITTELRDKREKKNALF
YKLDIVQLDGNSSQYRLINCNTSVITQACPKVSFDPIPIHYCAPAGYAILKCNNKTFNGTGPCNNVSTVQCTHGIKPVV
STQLLLNGSLAEGEIIIRSKNITDNGKTIIVHLNESVKIECTRPSNNTRTSIRIGPGQAFYATGQVIGDIREAHCNISE
SKWNETLQRVSEKLKEYFPHKNITFQPSSGGDLEITTHSFNCGGEFFYCNTSSLFNRTYMATSTDMANSTETNSTRIIT
IRCRIKQIINMWQEVGRAMYAPPIAGNITCISNITGLLLTRDGGKNDTDTFRPEGGNMKDNWRSELYKYKVVEVKPLGV
APTNARERVVEREKE*

>HV1300586, CH505w053.31D8gp120 (SEQ ID NO. 55)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLNCTDATASNATASNATASNSSIIEGMKNCSFNITTELRDKR
EKKNALFYKLDIVQLDGNSSQYRLINCNTSVITQACPKVSFDPIPIHYCAPAGYAILKCNNKTFNGTGPCNNVSTVQCT
HGIKPVVSTQLLLNGSLAEGEIIIRSENITDNGKTIIVHLNESVKIECTRPSNNTRTSIRIGPGQAFYATGQVIGDIRE
AHCNISESKWNETLQRVSKKLKEYFPHKNITFQPSSGGDLEITTHSFNCGGEFFYCNTSSLFNRTYMANSTETNSTRII
TIRCRIKQIINMWQEVGRAMYAPPIAGNITCISNITGLLLTRDGGNNNTETFRPGGGNMKDNWRSELYKYKVVEVKPLG
VAPTNARERVVEREKE*

Figure 1 cont.

6 gp160 constructs:

>CH505.M5gp160 (SEQ ID NO. 56)

gtcgacaagaaATGCGCGTGATGGGCATCCAGCGCAACTACCCGCAGTGGTGGATCTGGTCGATGCTGGGCTTCTGGAT
GCTCATGATCTGCAACGGCATGTGGGTGACGGTGTACTACGGCGTGCCGGTGTGGAAGGAGGCCAAGACGACCCTGTTC
TGCGCGTCGGACGCCAAGGCCTACGAGAAGGAGGTGCACAACGTGTGGGCGACCCACGCCTGCGTGCCCACGGACCCCA
ACCCGCAGGAGATGGTGCTGAAGAACGTGACCGAGAACTTCAACATGTGGAAGAACGACATGGTGGACCAGATGCACGA
GGACGTGATCTCCCTGTGGGACCAGTCCCTGAAGCCCTGCGTGAAGCTGACCCCGCTGTGCGTGACCCTGAACTGCACC
AACGCCACCGCGTCCAACTCCTCCATCATCGAGGGCATGAAGAACTGCTCCTTCAACATCACGACGGAGCTGCGCGACA
AGCGCGAGAAGAAGAACGCCCTGTTCTACAAGCTGGACATCGTGCAGCTGGACGGCAACTCCTCGCAGTACAGGCTGAT
CAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGT
GCACGCACGGGATCAAGCCCGTGGTGTCCACGCAGCTGCTCCTGAACGGGTCGCTGGCCGAGGGCGAGATCATCATCCG
GTCCGAGAACATCACGAAGAACGTGAAGACCATCATCGTGCACCTGAACGAGTCCGTGAAGATCGAGTGCACCCGCCCG
AACAACAAGACGCGCACCTCCATCCGGATCGGCCCTGGCCAGGCCTTCTACGCCACCGGCCAGGTGATCGGCGACATCC
GCGAGGCGTACTGCAACATCAACGAGTCCAAGTGGAACGAGACCCTGCAGCGCGTGTCCAAGAAGCTGAAGGAGTACTT
CCCCCACAAGAACATCACCTTCCAGCCGTCGTCCGGCGGCGACCTCGAGATCACCACGCACTCCTTCAACTGCGGTGGC
GAGTTCTTCTACTGCAACACGTCGTCGCTGTTCAACCGCACCTACATGGCCAACTCCACCGACATGGCCAACTCCACCG
AGACCAACTCCACGCGCACCATCACGATCCACTGCCGCATCAAGCAGATCATCAACATGTGGCAGGAGGTGGGCCGCGC
CATGTACGCACCGCCCATCGCCGGCAACATCACCTGCATCTCCAACATCACCGGCCTCCTGCTGACCCGCGACGGCGGC
AAGAACAACACGGAGACCTTCAGGCCAGGCGGAGGCAACATGAAGGACAACTGGCGCTCCGAGCTGTACAAGTACAAGG
TGGTGGAGGTGAAGCCCCTGGGCGTGGCACCCACCAACGCCCGCAGGCGCGTCGTGGAGCGCGAGAAGCGCGCCGTGGG
CATGGGCGCCGTGTTCCTGGGCTTCCTGGGCGCTGCGGGCTCCACCATGGGTGCCGCGTCCATCACCCTGACCGTGCAG
GCCCGCCAGCTGCTCTCCGGCATCGTGCAGCAGCAGTCCAACCTCCTGAAGGCCATCGAGGCCCAGCAGCACATGCTGA
AGCTGACCGTGTGGGGCATCAAGCAGCTGCAGGCCAGGGTGCTCGCGCTCGAGCGCTACCTGAAGGACCAGCAGCTGCT
CGGCATGTGGGGCTGCTCCGGCAAGCTGATCTGCACCACCAACGTGTACTGGAACTCGTCCTGGTCCAACAAGACCTAC
GGCGACATCTGGGACAACATGACCTGGATGCAGTGGGAGCGCGAGATCTCCAACTACACCGAGATCATCTACGAGCTCC
TCGAGGAGTCCCAGAACCAGCAGGAGAAGAACGAGCAGGATCTGCTCGCGCTGGACCGCTGGAACTCCCTGTGGAACTG
GTTCAACATCACCAACTGGCTGTGGTACATCAAGATCTTCATCATGATCGTGGGCGGCCTGATCGGCCTGCGCATCATC
TTCGCCGTGCTGTCGCTGGTGAACCGCGTGCGCCAGGGCTACTCCCCGCTGTCCCTGCAAACGCTGATCCCCTCCCCCC
GGGGCCCGGACAGGCCCGGTGGCATCGAGGAGGAGGGCGGCGAGCAGGACCGCAACCGCTCCACGCGCCTGGTGTCCGG
CTTCCTGGCCCTGGTGTGGGACGACCTGCGCTCCCTGTGCCTGTTCATCTACCACCGCCTGCGCGACTTCATCCTGATC
GCGGCCCGCGCTGGCGAGCTGCTGGGCCGGTCCTCGCTGAAGGGCCTGCGCCGCGGCTGGGAGGCCCTGAAGTACCTGG
GCTCGCTGGTGCAGTACTGGGGCCTGGAGCTGAAGCGCTCCGCCATCTCCCTGCTGGACACCCTGGCCATCGCCGTGGG
CGAGGGCACCGACCGCATCCTGGAGTTCGTGCTGGGCATCTGCCGCGCCATCCGCAACATCCCCACCCGCATCCGCCAG
GGCTTCGAGACCGCCCTCCTGTAGTAAGgtgaccgaattcgggacccggatcc

Figure 1 cont.

>CH505.M11gp160 (SEQ ID NO. 57)

gtcgacaagaaATGCGCGTGATGGGCATCCAGCGCAACTACCCGCAGTGGTGGATCTGGTCGATGCTGGGCTTCTGGAT
GCTCATGATCTGCAACGGCATGTGGGTGACGGTGTACTACGGCGTGCCGGTGTGGAAGGAGGCCAAGACGACCCTGTTC
TGCGCGTCGGACGCCAAGGCCTACGAGAAGGAGGTGCACAACGTGTGGGCGACCCACGCCTGCGTGCCCACGGACCCCA
ACCCGCAGGAGATGGTGCTGAAGAACGTGACCGAGAACTTCAACATGTGGAAGAACGACATGGTGGACCAGATGCACGA
GGACGTGATCTCCCTGTGGGACCAGTCCCTGAAGCCCTGCGTGAAGCTGACCCCGCTGTGCGTGACCCTGAACTGCACC
AACGCCACCGCGTCCAACTCCTCCATCATCGAGGGCATGAAGAACTGCTCCTTCAACATCACGACGGAGCTGCGCGACA
AGCGCGAGAAGAAGAACGCCCTGTTCTACAAGCTGGACATCGTGCAGCTGGACGGCAACTCCTCGCAGTACAGGCTGAT
CAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGT
GCACGCACGGGATCAAGCCCGTGGTGTCCACGCAGCTGCTCCTGAACGGGTCGCTGGCCGAGGGCGAGATCATCATCCG
GTCCGAGAACATCACGGACAACGGGAAGACCATCATCGTGCACCTGAACGAGTCCGTGAAGATCGAGTGCACCCGCCCG
AACAACAAGACGCGCACCTCCATCCGGATCGGCCCTGGCCAGGCCTTCTACGCCACCGGCCAGGTGATCGGCGACATCC
GCGAGGCGTACTGCAACATCAACGAGTCCAAGTGGAACGAGACCCTGCAGCGCGTGTCCAAGAAGCTGAAGGAGTACTT
CCCCCACAAGAACATCACCTTCCAGCCGTCGTCCGGCGGCGACCTCGAGATCACCACGCACTCCTTCAACTGCGGTGGC
GAGTTCTTCTACTGCAACACGTCGTCGCTGTTCAACCGCACCTACATGGCCAACTCCACCGACATGGCCAACTCCACCG
AGACCAACTCCACGCGCACCATCACGATCCACTGCCGCATCAAGCAGATCATCAACATGTGGCAGGAGGTGGGCCGCGC
CATGTACGCACCGCCCATCGCCGGCAACATCACCTGCATCTCCAACATCACCGGCCTCCTGCTGACCCGCGACGGCGGC
AAGAACAACACGGAGACCTTCAGGCCAGGCGGAGGCAACATGAAGGACAACTGGCGCTCCGAGCTGTACAAGTACAAGG
TGGTGGAGGTGAAGCCCCTGGGCGTGGCACCCACCAACGCCCGCAGGCGCGTCGTGGAGCGCGAGAAGCGCGCCGTGGG
CATGGGCGCCGTGTTCCTGGGCTTCCTGGGCGCTGCGGGCTCCACCATGGGTGCCGCGTCCATCACCCTGACCGTGCAG
GCCCGCCAGCTGCTCTCCGGCATCGTGCAGCAGCAGTCCAACCTCCTGAAGGCCATCGAGGCCCAGCAGCACATGCTGA
AGCTGACCGTGTGGGGCATCAAGCAGCTGCAGGCCAGGGTGCTCGCGCTCGAGCGCTACCTGAAGGACCAGCAGCTGCT
CGGCATGTGGGGCTGCTCCGGCAAGCTGATCTGCACCACCAACGTGTACTGGAACTCGTCCTGGTCCAACAAGACCTAC
GGCGACATCTGGGACAACATGACCTGGATGCAGTGGGAGCGCGAGATCTCCAACTACACCGAGATCATCTACGAGCTCC
TCGAGGAGTCCCAGAACCAGCAGGAGAAGAACGAGCAGGATCTGCTCGCGCTGGACCGCTGGAACTCCCTGTGGAACTG
GTTCAACATCACCAACTGGCTGTGGTACATCAAGATCTTCATCATGATCGTGGGCGGCCTGATCGGCCTGCGCATCATC
TTCGCCGTGCTGTCGCTGGTGAACCGCGTGCGCCAGGGCTACTCCCCGCTGTCCCTGCAAACGCTGATCCCCTCCCCCC
GGGGCCCGGACAGGCCCGGTGGCATCGAGGAGGAGGGCGGCGAGCAGGACCGCAACCGCTCCACGCGCCTGGTGTCCGG
CTTCCTGGCCCTGGTGTGGGACGACCTGCGCTCCCTGTGCCTGTTCATCTACCACCGCCTGCGCGACTTCATCCTGATC
GCGGCCCGCGCTGGCGAGCTGCTGGGCCGGTCCTCGCTGAAGGGCCTGCGCCGCGGCTGGGAGGCCCTGAAGTACCTGG
GCTCGCTGGTGCAGTACTGGGGCCTGGAGCTGAAGCGCTCCGCCATCTCCCTGCTGGACACCCTGGCCATCGCCGTGGG
CGAGGGCACCGACCGCATCCTGGAGTTCGTGCTGGGCATCTGCCGCGCCATCCGCAACATCCCCACCCGCATCCGCCAG
GGCTTCGAGACCGCCCTCCTGTAGTAAGgtgaccgaattcaggtcccggatcc

Figure 1 cont.

>CH505w020.14gp160 (SEQ ID NO. 58)

gtcgacaagaaATGCGCGTGATGGGCATCCAGCGCAACTACCCGCAGTGGTGGATCTGGTCGATGCTGGGCTTCTGGAT
GCTCATGATCTGCAACGGCATGTGGGTGACGGTGTACTACGGCGTGCCGGTGTGGAAGGAGGCCAAGACGACCCTGTTC
TGCGCGTCGGACGCCAAGGCCTACGAGAAGGAGGTGCACAACGTGTGGGCGACCCACGCCTGCGTGCCCACGGACCCCA
ACCCGCAGGAGATGGTGCTGAAGAACGTGACCGAGAACTTCAACATGTGGAAGAACGACATGGTGGACCAGATGCACGA
GGACGTGATCTCCCTGTGGGACCAGTCCCTGAAGCCCTGCGTGAAGCTGACCCCGCTGTGCGTGACCCTGAACTGCACC
AACGCCACCGCGTCCAACAACTCCATCATCGAGGGCATGAAGAACTGCTCCTTCAACATCACGACGGAGCTGCGCGACA
AGCGCGAGAAGAAGAACGCCCTGTTCTACAAGCTGGACATCGTGCAGCTGGACGGCAACTCCTCGCAGTACAGGCTGAT
CAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGT
GCACGCACGGGATCAAGCCCGTGGTGTCCACGCAGCTGCTCCTGAACGGGTCGCTGGCCGAGGGCGAGATCATCATCCG
GTCCGAGAACATCACGAACAACGCGAAGACCATCATCGTGCACCTGAACGAGTCCGTGAAGATCGAGTGCACCCGCCCG
AACAACAAGACGCGCACGTCCATCCGGATCGGCCCTGGCCAGGCCTTCTACGCCACCGGCCAGGTGATCGGCGACATCC
GCAAGGCGTACTGCAACATCTCGGAGTCCAAGTGGAACGAGACCCTGCAGCGCGTGTCCAAGAAGCTGAAGGAGTACTT
CCCCCACAAGAACATCACCTTCCAGCCGTCGTCCGGCGGCGACCTCGAGATCACCACGCACTCCTTCAACTGCGGTGGC
GAGTTCTTCTACTGCAACACGTCGTCGCTGTTCAACCGCACCTACATGGCCAACTCCACCGACATGGCCAACTCCACCG
AGACCAACTCCACGCGCACCATCACGCTCCACTGCCGCATCAAGCAGATCATCAACATGTGGCAGGAGGTGGGCCGCGC
CATGTACGCACCGCCCATCGCCGGCAACATCACCTGCATCTCCAACATCACCGGCCTCCTGCTGACCCGCGACGGCGGC
AAGAACAACACGGAGACCTTCAGGCCAGGCGGAGGCAACATGAAGGACAACTGGCGCTCCGAGCTGTACAAGTACAAGG
TGGTGGAGGTGAAGCCCCTGGGCGTGGCACCCACCAACGCCCGCAGGCGCGTCGTGGAGCGCGAGAAGCGCGCCGTGGG
CATGGGCGCCGTGTTCCTGGGCTTCCTGGGCGCTGCGGGCTCCACCATGGGTGCCGCGTCCATCACCCTGACCGTGCAG
GCCCGCCAGCTGCTCTCCGGCATCGTGCAGCAGCAGTCCAACCTCCTGAAGGCCATCGAGGCCCAGCAGCACATGCTGA
AGCTGACCGTGTGGGGCATCAAGCAGCTGCAGGCCAGGGTGCTCGCGCTCGAGCGCTACCTGAAGGACCAGCAGCTGCT
CGGCATGTGGGGCTGCTCCGGCAAGCTGATCTGCACCACCAACGTGTACTGGAACTCGTCCTGGTCCAACAAGACCTAC
GGCGACATCTGGGACAACATGACCTGGATGCAGTGGGAGCGCGAGATCTCCAACTACACCGAGATCATCTACGAGCTCC
TCGAGGAGTCCCAGAACCAGCAGGAGAAGAACGAGCAGGATCTGCTCGCGCTGGACCGCTGGAACTCCCTGTGGAACTG
GTTCAACATCACCAACTGGCTGTGGTACATCAAGATCTTCATCATGATCGTGGGCGGCCTGATCGGCCTGCGCATCATC
TTCGCCGTGCTGTCGCTGGTGAACCGCGTGCGCCAGGGCTACTCCCCGCTGTCCCTGCAAACGCTGATCCCCTCCCCCC
GGGGCCCGGACAGGCCCGGTGGCATCGAGGAGGAGGGCGGCGAGCAGGACCGCAACCGCTCCACGCGCCTGGTGTCCGG
CTTCCTGGCCCTGGTGTGGGACGACCTGCGCTCCCTGTGCCTGTTCATCTACCACCGCCTGCGCGACTTCATCCTGATC
GCGGCCCGCGCTGGCGAGCTGCTGGGCCGGTCCTCGCTGAAGGGCCTGCGCCGCGGCTGGGAGGCCCTGAAGTACCTGG
GCTCGCTGGTGCAGTACTGGGGCCTGGAGCTGAAGCGCTCCGCCATCTCCCTGCTGGACACCCTGGCCATCGCCGTGGG
CGAGGGCACCGACCGCATCCTGGAGTTCGTGCTGGGCATCTGCCGCGCCATCCGCAACATCCCCACCCGCATCCGCCAG
GGCTTCGAGACCGCCCTCCTGTAGTAAGggacccgaattcggtcaccggatcc

Figure 1 cont.

>CH505w030.28gp160 (SEQ ID NO. 59)

gtcgacaagaaATGCGCGTGATGGGCATCCAGCGCAACTACCCGCAGTGGTGGATCTGGTCGATGCTGGGCTTCTGGAT
GCTCATGATCTGCAACGGCATGTGGGTGACGGTGTACTACGGCGTGCCGGTGTGGAAGGAGGCCAAGACGACCCTGTTC
TGCGCGTCGGACGCCAAGGCCTACGAGAAGGAGGTGCACAACGTGTGGGCGACCCACGCCTGCGTGCCCACGGACCCCA
ACCCGCAGGAGATGGTGCTGAAGAACGTGACCGAGAACTTCAACATGTGGAAGAACGACATGGTGGACCAGATGCACGA
GGACGTGATCTCCCTGTGGGACCAGTCCCTGAAGCCCTGCGTGAAGATGACCCCGCTGTGCGTGACCCTGAACTGCACC
AACGCCACCGCGATCAACTCCTCCATCATCGAGGGCATGAAGAACTGCTCCTTCAACATCACGACGGAGCTGCGCGACA
AGCGCGAGAAGAAGAACGCCCTGTTCTACAAGCTGGACATCGTGCAGCTGGACGGCAACTCCTCGCAGTACAGGCTGAT
CAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGT
GCACGCACGGGATCAAGCCCGTGGTGTCCACGCAGCTGCTCCTGAACGGGTCGCTGGCCGAGGGCGAGATCATCATCCG
GTCCGAGAACATCACGAACAACGACAAGACCATCATCGTGCACCTGAACGAGTCCGTGAAGATCGAGTGCACCCGCCCG
AACAACAAGACGCGCACCTCCATCCGGATCGGCCCTGGCCAGGCCTTCTACGCCACCGGCCAGGTGATCGGCGACATCC
GCGAGGCGCACTGCAACATCTCGGAGTCCAAGTGGAACGAGACCCTGCAGCGCGTGTCCAAGAAGCTGAAGGAGTACTT
CCCCCACAAGAACATCACCTTCCAGCCGTCGTCCGGCGGCGACCTCGAGATCACCACGCACTCCTTCAACTGCGGTGGC
GAGTTCTTCTACTGCAACACGTCGTCGCTGTTCAACCGCACCTACATGGCCAACTCCACCGACATGGCCAACTCCACCG
AGACCAACTCCACGCGCACCATCACGATCCGCTGCCGCATCAAGCAGATCATCAACATGTGGCAGGAGGTGGGCCGCGC
CATGTACGCACCGCCCATCGCCGGCAACATCACCTGCATCTCCAACATCACCGGCCTCCTGCTGACCCGCGACGGCGGC
AAGAACAACACGGAGACCTTCAGGCCAGGCGGAGGCAACATGAAGGACAACTGGCGCTCCGAGCTGTACAAGTACAAGG
TGGTGGAGGTGAAGCCCCTGGGCGTGGCACCCACCAACGCCCGCAGGCGCGTCGTGGAGCGCGAGAAGCGCGCCGTGGG
CATGGGCGCCGTGTTCCTGGGCTTCCTGGGCGCTGCGGGCTCCACCATGGGTGCCGCGTCCATCACCCTGACCGTGCAG
GCCCGCCAGCTGCTCTCCGGCATCGTGCAGCAGCAGTCCAACCTCCTGAAGGCCATCGAGGCCCAGCAGCACATGCTGA
AGCTGACCGTGTGGGGCATCAAGCAGCTGCAGGCCAGGGTGCTCGCGCTCGAGCGCTACCTGAAGGACCAGCAGCTGCT
CGGCATGTGGGGCTGCTCCGGCAAGCTGATCTGCACCACCAACGTGTACTGGAACTCGTCCTGGTCCAACAAGAGCTAC
GGCGACATCTGGGACAACATGACCTGGATGCAGTGGGAGCGCGAGATCTCCAACTACACCGAGATCATCTACGAGCTCC
TCGAGGAGTCCCAGAACCAGCAGGAGAAGAACGAGCAGGATCTGCTCGCGCTGGACCGCTGGAACTCCCTGTGGAACTG
GTTCAACATCACCAACTGGCTGTGGTACATCAAGATCTTCATCATGATCGTGGGCGGCCTGATCGGCCTGCGCATCATC
TTCGCCGTGCTGTCGCTGGTGAACCGCGTGCGCCAGGGCTACTCCCCGCTGTCCCTGCAAACGCTGATCCCCTCCCCCC
GGGGCCCGGACAGGCCCGGTGGCATCGAGGAGGAGGGCGGCGAGCAGGACCGCAACCGCTCCACGCGCCTGGTGTCCGG
CTTCCTGGCCCTGGTGTGGGACGACCTGCGCTCCCTGTGCCTGTTCATCTACCACCGCCTGCGCGACTTCATCCTGATC
GCGGCCCGCGCTGGCGAGCTGCTGGGCCGGTCCTCGCTGAAGGGCCTGCGCCGCGGCTGGGAGGCCCTGAAGTACCTGG
GCTCGCTGGTGCAGTACTGGGGCCTGGAGCTGAAGCGCTCCGCCATCTCCCTGCTGGACACCCTGGCCATCGCCGTGGG
CGAGGGCACCGACCGCATCCTGGAGTTCGTGCTGGGCATCTGCCGCGCCATCCGCAACATCCCCACCCGCATCCGCCAG
GGCTTCGAGACCGCCCTCCTGTAGTAAGggtcctgaattcggttaccggatcc

Figure 1 cont.

>CH505w078.15gp160 (SEQ ID NO. 60)

gtcgacaagaaATGCGCGTGATGGGCATCCAGCGCAACTACCCGCAGTGGTGGATCTGGTCGATGCTGGGCTTCTGGAT
GCTCATGATCTGCAACGGCATGTGGGTGACGGTGTACTACGGCGTGCCGGTGTGGAAGGAGGCCAAGACGACCCTGTTC
TGCGCGTCGGACGCCAAGGCCTACGAGAAGGAGGTGCACAACGTGTGGGCGACCCACGCCTGCGTGCCCACGGACCCCA
ACCCGCAGGAGATGGTGCTGAAGAACGTGACCGAGAACTTCAACATGTGGAAGAACGACATGGTGGACCAGATGCACGA
GGACGTGATCTCCCTGTGGGACCAGTCCCTGAAGCCCTGCGTGAAGCTGACCCCGCTGTGCGTGACCCTGAGCTGCACG
AACGCCACCAACGCGACGGCGTCGAACTCGTCCATCCTCGAGGGGATGAAGAACTGCTCCTTCAACATCACGACGGAGC
TGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTAC
TGCGCCCCCGCCGGCTACGCCATCCTGAAGTGCAACAACAAGACCTTCAACGGCACCGGCCCGTGCAACAACGTGTCCA
CCGTGCAGTGCACGCACGGGATCAAGCCCGTGGTGTCCACGCAGCTGCTCCTGAACGGGTCGCTGGCCGAGGGCGAGAT
CATCATCCGGTCGAAGAACATCACGGACAACGGGAAGACCATCATCGTGCACCTGAACGAGTCCGTGAAGATCGAGTGC
ACCCGCCCGAGCAACAACACGCGCACCTCCATCCGGATCGGCCCTGGCCAGGCCTTCTACGCCACCGGCCAGGTGATCG
GCGACATCCGCGAGGCGCACTGCAACATCTCCGAGTCCAAGTGGAACGAGACCCTGCAGCGCGTGTCCGAGAAGCTGAA
GGAGTACTTCCCCCACAAGAACATCACCTTCCAGCCGTCGTCCGGCGGCGACCTCGAGATCACCACGCACTCCTTCAAC
TGCGGTGGCGAGTTCTTCTACTGCAACACGTCGTCGCTGTTCAACCGCACCTACATGGCCACCTCCACCGACATGGCCA
ACTCCACCGAGACCAACTCCACGCGCATCATCACGATCCGCTGCCGCATCAAGCAGATCATCAACATGTGGCAGGAGGT
GGGCCGCGCCATGTACGCACCGCCCATCGCCGGCAACATCACCTGCATCTCCAACATCACCGGCCTCCTGCTGACCCGC
GACGGCGGCAAGAACGACACGGACACCTTCAGGCCAGAGGGAGGCAACATGAAGGACAACTGGCGCTCCGAGCTGTACA
AGTACAAGGTGGTGGAGGTGAAGCCCCTGGGCGTGGCACCCACCAACGCCCGCAGGCGCGTCGTGGAGCGCGAGAAGCG
CGCCGTGGGCATGGGCGCCGTGTTCCTGGGCTTCCTGGGCGCTGCGGGCTCCACCATGGGTGCCGCGTCCATCACCCTG
ACCGTGCAGGCCCGCCAGCTGCTCTCCGGCATCGTGCAGCAGCAGTCCAACCTCCTGAAGGCCATCGAGGCCCAGCAGC
ACATGCTGAAGCTGACCGTGTGGGGCATCAAGCAGCTGCAGGCCAGGGTGCTCGCGCTCGAGCGCTACCTGAAGGACCA
GCAGCTGCTCGGCATGTGGGGCTGCTCCGGCAAGCTGATCTGCACCACCAACGTGTACTGGAACTCGTCCTGGTCCAAC
AAGACCTACGGCGACATCTGGGACAACATGACCTGGATGCAGTGGGAGCGCGAGATCTCCAACTACACCGAGCTGATCT
ACGAGCTCCTCGAGGAGTCCCAGAACCAGCAGGAGAAGAACGAGCAGGATCTGCTCGCGCTGGACCGCTGGAACTCCCT
GTGGAACTGGTTCAACATCACCAACTGGCTGTGGTACATCAAGATCTTCATCATGATCGTGGGCGGCCTGATCGGCCTG
CGCATCATCTTCGCCGTGCTGTCGCTGGTGAACCGCGTGCGCCAGGGCTACTCCCCGCTGTCCCTGCAAACGCTGATCC
CCTCCCCCCGGGGCCCGGACAGGCCCGGTGGCATCGAGGAGGAGGGCGGCGAGCAGGACCGCAACCGCTCCACGCGCCT
GGTGTCCGGCTTCCTGGCCCTGGCGTGGGACGACCTGCGCTCCCTGTGCCTGTTCATCTACCACCGCCTGCGCGACTTC
ATCCTGATCGCGGCCCGCGCTGGCGAGCTGCTGGGCCGGTCCTCGCTGAAGGGCCTGCGCCGCGGCTGGGAGGCCCTGA
AGTACCTGGGCAACCTGGTGCAGTACTGGGGCCTGGAGCTGAAGCGCTCCGCCATCTCCCTGCTGGACACCCTGGCCAT
CGCCGTGGGCGAGGGCACCGACCGCATCCTGGAGTTCGTGCTGGGCATCTGCCGCGCCATCCGCAACATCCCCACCCGC
ATCCGCCAGGGCTTCGAGACCGCCCTCCTGTAGTAAGaattcggtcaccgggtcctggatcc

Figure 1 cont.

>CH505w053.31gp160 (SEQ ID NO. 61)

gtcgacaagaaATGCGCGTGATGGGCATCCAGCGCAACTACCCGCAGTGGTGGATCTGGTCGATGCTGGGCTTCTGGAT
GCTCATGATCTGCAACGGCATGTGGGTGACGGTGTACTACGGCGTGCCGGTGTGGAAGGAGGCCAAGACGACCCTGTTC
TGCGCGTCGGACGCCAAGGCCTACGAGAAGGAGGTGCACAACGTGTGGGCGACCCACGCCTGCGTGCCCACGGACCCCA
ACCCGCAGGAGATGGTGCTGAAGAACGTGACCGAGAACTTCAACATGTGGAAGAACGACATGGTGGACCAGATGCACGA
GGACGTGATCTCCCTGTGGGACCAGTCCCTGAAGCCCTGCGTGAAGCTGACCCCGCTGTGCGTGACCCTGAACTGCACC
GACGCCACCGCGTCCAACGCAACCGCGAGCAACGCCACGGCGTCGAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCT
GGACGGCAACTCCTCGCAGTACAGGCTGATCAACTGCAACACCTCCGTCATCACGCAGGCGTGCCCCAAGGTGTCCTTC
GACCCCATCCCCATCCACTACTGCGCCCCCGCCGGCTACGCCATCCTGAAGTGCAACAACAAGACCTTCAACGGCACCG
GCCCGTGCAACAACGTGTCCACCGTGCAGTGCACGCACGGGATCAAGCCCGTGGTGTCCACGCAGCTGCTCCTGAACGG
GTCGCTGGCCGAGGGCGAGATCATCATCCGGTCCGAGAACATCACGGACAACGGGAAGACCATCATCGTGCACCTGAAC
GAGTCCGTGAAGATCGAGTGCACCCGCCCGTCGAACAACACGCGCACCTCCATCCGGATCGGCCCTGGCCAGGCCTTCT
ACGCCACCGGCCAGGTGATCGGCGACATCCGCGAGGCGCACTGCAACATCTCGGAGTCCAAGTGGAACGAGACCCTGCA
GCGCGTGTCCAAGAAGCTGAAGGAGTACTTCCCCCACAAGAACATCACCTTCCAGCCGTCGTCCGGCGGCGACCTCGAG
ATCACCACGCACTCCTTCAACTGCGGTGGCGAGTTCTTCTACTGCAACACGTCGTCGCTGTTCAACCGCACCTACATGG
CCAACTCCACCGAGACCAACTCCACGCGCATCATCACGATCCGCTGCCGCATCAAGCAGATCATCAACATGTGGCAGGA
GGTGGGCCGCGCCATGTACGCACCGCCCATCGCCGGCAACATCACCTGCATCTCCAACATCACCGGCCTCCTGCTGACC
CGCGACGGCGGCAACAACAACACGGAGACCTTCAGGCCAGGCGGAGGCAACATGAAGGACAACTGGCGCTCCGAGCTGT
ACAAGTACAAGGTGGTGGAGGTGAAGCCCCTGGGCGTGGCACCCACCAACGCCCGCAGGCGCGTCGTGGAGCGCGAGAA
GCGCGCCGTGGGCATGGGCGCCGTGTTCCTGGGCTTCCTGGGCGCTGCGGGCTCCACCATGGGTGCCGCGTCCATCACC
CTGACCGTGCAGGCCCGCCAGCTGCTCTCCGGCATCGTGCAGCAGCAGTCCAACCTCCTGAAGGCCATCGGGGCCCAGC
AGCACATGCTGAAGCTGACCGTGTGGGGCATCAAGCAGCTGCAGGCCAGGGTGCTCGCGCTCGAGCGCTACCTGAAGGA
CCAGCAGCTGCTCGGCATGTGGGGCTGCTCCGGCAAGCTGATCTGCACCACCAACGTGTACTGGAACTCGTCCTGGTCC
AACAAGACCTACGGCGACATCTGGGACAACATGACCTGGATGCAGTGGGAGCGCGAGATCTCCAACTACACCGAGATGA
TCTACGAGCTCCTCGAGGAGTCCCAGAACCAGCAGGAGAAGAACGAGCAGGATCTGCTCGCGCTGGACCGCTGGAACTC
CCTGTGGAACTGGTTCAACATCACCAACTGGCTGTGGTACATCAAGATCTTCATCATGATCGTGGGCGGCCTGATCGGC
CTGCGCATCATCTTCGCCGTGCTGTCGCTGGTGAACCGCGTGCGCCAGGGCTACTCCCCGCTGTCCCTGCAAACGCTGA
TCCCCTCCCCCCGGGGCCCGGACAGGCCCGGTGGCATCGAGGAGGAGGGCGGCGAGCAGGACCGCAAGCGCTCCACGCG
CCTGGTGTCCGGCTTCCTGGCCCTGGTGTGGGACGACCTGCGCTCCCTGTGCCTGTTCATCTACCACCGCCTGCGCGAC
TTCATCCTGATCGCGGCCCGCGCTGGCGAGCTGCTGGGCCGGTCCTCGCTGAAGGGCCTGCGCCGCGGCTGGGAGGCCC
TGAAGTACCTGGGCTCGCTGGTGCAGTACTGGGGCCTGGAGCTGAAGCGCTCCGCCATCTCCCTGCTGGACACCCTGGC
CATCGCCGTGGGCGAGGGCACCGACCGCATCCTGGAGTTCGCGCTGGGCATCTGCCGCGCCATCCGCAACATCCCCACC
CGCATCCGCCAGGGCTTCGAGACCGCCCTCCTGTAGTAAGaattcggtgaccgggacctggatcc

Figure 1 cont.

>CH505.M5gp160 (SEQ ID NO. 62)
MRVMGIQRNYPQWWIWSMLGFWMLMICNGMWVTVYYGVPVWKEAKTTLFCASDAKAYEKEVHNVWATHACVPTDPNPQEM
VLKNVTENFNMWKNDMVDQMHEDVISLWDQSLKPCVKLTPLCVTLNCTNATASNSSIIEGMKNCSFNITTELRDKREKKN
ALFYKLDIVQLDGNSSQYRLINCNTSVITQACPKVSFDPIPIHYCAPAGYAILKCNNKTFTGTGPCNNVSTVQCTHGIKP
VVSTQLLLNGSLAEGEIIIRSENITKNVKTIIVHLNESVKIECTRPNNKTRTSIRIGPGQAFYATGQVIGDIREAYCNIN
ESKWNETLQRVSKKLKEYFPHKNITFQPSSGGDLEITTHSFNCGGEFFYCNTSSLFNRTYMANSTDMANSTETNSTRTIT
IHCRIKQIINMWQEVGRAMYAPPIAGNITCISNITGLLLTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLKAIEAQQHMLKLTVWGIKQLQ
ARVLALERYLKDQQLLGMWGCSGKLICTTNVYWNSSWSNKTYGDIWDNMTWMQWEREISNYTEIIYELLEESQNQQEKNE
QDLLALDRWNSLWNWFNITNWLWYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLRRGWEALKYLGSLVQYWGLELKRS
AISLLDTLAIAVGEGTDRILEFVLGICRAIRNIPTRIRQGFETALL*

>CH505.M11gp160 (SEQ ID NO. 63)
MRVMGIQRNYPQWWIWSMLGFWMLMICNGMWVTVYYGVPVWKEAKTTLFCASDAKAYEKEVHNVWATHACVPTDPNPQEM
VLKNVTENFNMWKNDMVDQMHEDVISLWDQSLKPCVKLTPLCVTLNCTNATASNSSIIEGMKNCSFNITTELRDKREKKN
ALFYKLDIVQLDGNSSQYRLINCNTSVITQACPKVSFDPIPIHYCAPAGYAILKCNNKTFTGTGPCNNVSTVQCTHGIKP
VVSTQLLLNGSLAEGEIIIRSENITDNGKTIIVHLNESVKIECTRPNNKTRTSIRIGPGQAFYATGQVIGDIREAYCNIN
ESKWNETLQRVSKKLKEYFPHKNITFQPSSGGDLEITTHSFNCGGEFFYCNTSSLFNRTYMANSTDMANSTETNSTRTIT
IHCRIKQIINMWQEVGRAMYAPPIAGNITCISNITGLLLTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLKAIEAQQHMLKLTVWGIKQLQ
ARVLALERYLKDQQLLGMWGCSGKLICTTNVYWNSSWSNKTYGDIWDNMTWMQWEREISNYTEIIYELLEESQNQQEKNE
QDLLALDRWNSLWNWFNITNWLWYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLRRGWEALKYLGSLVQYWGLELKRS
AISLLDTLAIAVGEGTDRILEFVLGICRAIRNIPTRIRQGFETALL*

>CH505w020.14gp160 (SEQ ID NO. 64)
MRVMGIQRNYPQWWIWSMLGFWMLMICNGMWVTVYYGVPVWKEAKTTLFCASDAKAYEKEVHNVWATHACVPTDPNPQEM
VLKNVTENFNMWKNDMVDQMHEDVISLWDQSLKPCVKLTPLCVTLNCTNATASNNSIIEGMKNCSFNITTELRDKREKKN
ALFYKLDIVQLDGNSSQYRLINCNTSVITQACPKVSFDPIPIHYCAPAGYAILKCNNKTFTGTGPCNNVSTVQCTHGIKP
VVSTQLLLNGSLAEGEIIIRSENITNNAKTIIVHLNESVKIECTRPNNKTRTSIRIGPGQAFYATGQVIGDIRKAYCNIS
ESKWNETLQRVSKKLKEYFPHKNITFQPSSGGDLEITTHSFNCGGEFFYCNTSSLFNRTYMANSTDMANSTETNSTRTIT
LHCRIKQIINMWQEVGRAMYAPPIAGNITCISNITGLLLTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLKAIEAQQHMLKLTVWGIKQLQ
ARVLALERYLKDQQLLGMWGCSGKLICTTNVYWNSSWSNKTYGDIWDNMTWMQWEREISNYTEIIYELLEESQNQQEKNE
QDLLALDRWNSLWNWFNITNWLWYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLRRGWEALKYLGSLVQYWGLELKRS
AISLLDTLAIAVGEGTDRILEFVLGICRAIRNIPTRIRQGFETALL*

Figure 1 cont.

>CH505w030.28gp160 (SEQ ID NO. 65)

MRVMGIQRNYPQWWIWSMLGFWMLMICNGMWVTVYYGVPVWKEAKTTLFCASDAKAYEKEVHNVWATHACVPTDPNPQEM
VLKNVTENFNMWKNDMVDQMHEDVISLWDQSLKPCVKMTPLCVTLNCTNATAINSSIIEGMKNCSFNITTELRDKREKKN
ALFYKLDIVQLDGNSSQYRLINCNTSVITQACPKVSFDPIPIHYCAPAGYAILKCNNKTFTGTGPCNNVSTVQCTHGIKP
VVSTQLLLNGSLAEGEIIIRSENITNNDKTIIVHLNESVKIECTRPNNKTRTSIRIGPGQAFYATGQVIGDIREAHCNIS
ESKWNETLQRVSKKLKEYFPHKNITFQPSSGGDLEITTHSFNCGGEFFYCNTSSLFNRTYMANSTDMANSTETNSTRTIT
IRCRIKQIINMWQEVGRAMYAPPIAGNITCISNITGLLLTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLKAIEAQQHMLKLTVWGIKQLQ
ARVLALERYLKDQQLLGMWGCSGKLICTTNVYWNSSWSNKSYGDIWDNMTWMQWEREISNYTEIIYELLEESQNQQEKNE
QDLLALDRWNSLWNWFNITNWLWYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLRRGWEALKYLGSLVQYWGLELKRS
AISLLDTLAIAVGEGTDRILEFVLGICRAIRNIPTRIRQGFETALL*

>CH505w078.15gp160 (SEQ ID NO. 66)

MRVMGIQRNYPQWWIWSMLGFWMLMICNGMWVTVYYGVPVWKEAKTTLFCASDAKAYEKEVHNVWATHACVPTDPNPQEM
VLKNVTENFNMWKNDMVDQMHEDVISLWDQSLKPCVKLTPLCVTLSCTNATNATASNSSILEGMKNCSFNITTELRDKRE
KKNALFYKLDIVQLDGNSSQYRLINCNTSVITQACPKVSFDPIPIHYCAPAGYAILKCNNKTFNGTGPCNNVSTVQCTHG
IKPVVSTQLLLNGSLAEGEIIIRSKNITDNGKTIIVHLNESVKIECTRPSNNTRTSIRIGPGQAFYATGQVIGDIREAHC
NISESKWNETLQRVSEKLKEYFPHKNITFQPSSGGDLEITTHSFNCGGEFFYCNTSSLFNRTYMATSTDMANSTETNSTR
IITIRCRIKQIINMWQEVGRAMYAPPIAGNITCISNITGLLLTRDGGKNDTDTFRPEGGNMKDNWRSELYKYKVVEVKPL
GVAPTNARRRVVEREKRAVGMGAVFLGFLGAAGSTMGAASITLTVQARQLLSGIVQQQSNLLKAIEAQQHMLKLTVWGIK
QLQARVLALERYLKDQQLLGMWGCSGKLICTTNVYWNSSWSNKTYGDIWDNMTWMQWEREISNYTELIYELLEESQNQQE
KNEQDLLALDRWNSLWNWFNITNWLWYIKIFIMIVGGLIGLRIIFAVLSLVNRVRQGYSPLSLQTLIPSPRGPDRPGGIE
EEGGEQDRNRSTRLVSGFLALAWDDLRSLCLFIYHRLRDFILIAARAGELLGRSSLKGLRRGWEALKYLGNLVQYWGLEL
KRSAISLLDTLAIAVGEGTDRILEFVLGICRAIRNIPTRIRQGFETALL*

Figure 1 cont.

>CH505w053.31gp160 (SEQ ID NO. 67)

MRVMGIQRNYPQWWIWSMLGFWMLMICNGMWVTVYYGVPVWKEAKTTLFCASDAKAYEKEVHNVWATHACVPTDPNPQEM
VLKNVTENFNMWKNDMVDQMHEDVISLWDQSLKPCVKLTPLCVTLNCTDATASNATASNATASNSSIIEGMKNCSFNITT
ELRDKREKKNALFYKLDIVQLDGNSSQYRLINCNTSVITQACPKVSFDPIPIHYCAPAGYAILKCNNKTFNGTGPCNNVS
TVQCTHGIKPVVSTQLLLNGSLAEGEIIIRSENITDNGKTIIVHLNESVKIECTRPSNNTRTSIRIGPGQAFYATGQVIG
DIREAHCNISESKWNETLQRVSKKLKEYFPHKNITFQPSSGGDLEITTHSFNCGGEFFYCNTSSLFNRTYMANSTETNST
RIITIRCRIKQIINMWQEVGRAMYAPPIAGNITCISNITGLLLTRDGGNNNTETFRPGGGNMKDNWRSELYKYKVVEVKP
LGVAPTNARRRVVEREKRAVGMGAVFLGFLGAAGSTMGAASITLTVQARQLLSGIVQQQSNLLKAIGAQQHMLKLTVWGI
KQLQARVLALERYLKDQQLLGMWGCSGKLICTTNVYWNSSWSNKTYGDIWDNMTWMQWEREISNYTEMIYELLEESQNQQ
EKNEQDLLALDRWNSLWNWFNITNWLWYIKIFIMIVGGLIGLRIIFAVLSLVNRVRQGYSPLSLQTLIPSPRGPDRPGGI
EEEGGEQDRKRSTRLVSGFLALVWDDLRSLCLFIYHRLRDFILIAARAGELLGRSSLKGLRRGWEALKYLGSLVQYWGLE
LKRSAISLLDTLAIAVGEGTDRILEFALGICRAIRNIPTRIRQGFETALL*

Figure 1 cont.

| Env name | Plasmid ID | Bar code |
|---|---|---|
| CH505.M5gp145 | HV1300656 | **TGATGAG**gtgaccgaattcgggacccggatcc (SEQ ID NO. 68) |
| CH505.M11gp145 | HV1300662 | **TGATGAG**gtgaccgaattcaggtcccggatcc(SEQ ID NO. 69) |
| CH505w020.14gp145 | HV1300635 | **TGATGAG**ggacccgaattcggtcaccggatcc(SEQ ID NO. 70) |
| CH505w030.28gp145 | HV1300636 | **TGATGAG**ggtcctgaattcggttaccggatcc(SEQ ID NO. 71) |
| CH505w078.15gp145 | HV1300639 | **TGATGAG**aattcggtcaccgggtcctggatcc(SEQ ID NO. 72) |
| CH505w53.16gp145 | HV1300696 | **TGATGAG**aattcggtgaccgggtcccggatcc(SEQ ID NO. 73) |
| CH505w30.21gp145 | HV1300689 | **TGATGAG**ggtcccgaattcggttaccggatcc(SEQ ID NO. 74) |
| CH505w78.33gp145 | HV1300705 | **TGATGAG**aattcggtaaccaggtcccggatcc(SEQ ID NO. 75) |
| CH505w100.B6gp145 | HV1300714 | **TGATGAG**gtaaccgggacccgaattcggatcc(SEQ ID NO. 76) |
| CH505w053.31gp145 | HV1300638 | **TGATGAG**aattcggtgaccgggacctggatcc(SEQ ID NO. 77) |

CH505 Env gp145 gene constructs were cloned into VRC8400 at the unique SalI and BamHI sites.

Figure 2A

>HV1300656, CH505.M5gp145 (SEQ ID NO. 78)
gtcgacaagaagccaccATGCGCGTGATGGGCATCCAGCGCAACTACCCGCAGTGGTGGATCTGGTCGATGCTGGGCTT
CTGGATGCTCATGATCTGCAACGGCATGTGGGTGACGGTGTACTACGGCGTGCCGGTGTGGAAGGAGGCCAAGACGACC
CTGTTCTGCGCGTCGGACGCCAAGGCCTACGAGAAGGAGGTGCACAACGTGTGGGCGACCCACGCCTGCGTGCCCACGG
ACCCCAACCCGCAGGAGATGGTGCTGAAGAACGTGACCGAGAACTTCAACATGTGGAAGAACGACATGGTGGACCAGAT
GCACGAGGACGTGATCTCCCTGTGGGACCAGTCCCTGAAGCCCTGCGTGAAGCTGACCCCGCTGTGCGTGACCCTGAAC
TGCACCAACGCCACCGCGTCCAACTCCTCCATCATCGAGGGCATGAAGAACTGCTCCTTCAACATCACGACGGAGCTGC
GCGACAAGCGCGAGAAGAAGAACGCCCTGTTCTACAAGCTGGACATCGTGCAGCTGGACGGCAACTCCTCGCAGTACAG
GCTGATCAACTGCAACACCTCCGTCATCACGCAGGCGTGCCCCAAGGTGTCCTTCGACCCCATCCCCATCCACTACTGC
GCCCCCGCCGGCTACGCCATCCTGAAGTGCAACAACAAGACCTTCACCGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCAT
CATCCGGTCCGAGAACATCACGAAGAACGTGAAGACCATCATCGTGCACCTGAACGAGTCCGTGAAGATCGAGTGCACC
CGCCCGAACAACAAGACGCGCACCTCCATCCGGATCGGCCCTGGCCAGGCCTTCTACGCCACCGGCCAGGTGATCGGCG
ACATCCGCGAGGCGTACTGCAACATCAACGAGTCCAAGTGGAACGAGACCCTGCAGCGCGTGTCCAAGAAGCTGAAGGA
GTACTTCCCCCACAAGAACATCACCTTCCAGCCGTCGTCCGGCGGCGACCTCGAGATCACCACGCACTCCTTCAACTGC
GGTGGCGAGTTCTTCTACTGCAACACGTCGTCGCTGTTCAACCGCACCTACATGGCCAACTCCACCGACATGGCCAACT
CCACCGAGACCAACTCCACGCGCACCATCACGATCCACTGCCGCATCAAGCAGATCATCAACATGTGGCAGGAGGTGGG
CCGCGCCATGTACGCACCGCCCATCGCCGGCAACATCACCTGCATCTCCAACATCACCGGCCTCCTGCTGACCCGCGAC
GGCGGCAAGAACAACACGGAGACCTTCAGGCCAGGCGGAGGCAACATGAAGGACAACTGGCGCTCCGAGCTGTACAAGT
ACAAGGTGGTGGAGGTGAAGCCCCTGGGCGTGGCACCCACCAACGCCCGCAGGCGCGTCGTGGAGCGCGAGAAGCGCGC
CGTGGGCATGGGCGCCGTGTTCCTGGGCTTCCTGGGCGCTGCGGGCTCCACCATGGGTGCCGCGTCCATCACCCTGACC
GTGCAGGCCCGCCAGCTGCTCTCCGGCATCGTGCAGCAGCAGTCCAACCTCCTGAAGGCCATCGAGGCCCAGCAGCACA
TGCTGAAGCTGACCGTGTGGGGCATCAAGCAGCTGCAGGCCAGGGTGCTCGCGCTCGAGCGCTACCTGAAGGACCAGCA
GCTGCTCGGCATGTGGGGCTGCTCCGGCAAGCTGATCTGCACCACCAACGTGTACTGGAACTCGTCCTGGTCCAACAAG
ACCTACGGCGACATCTGGGACAACATGACCTGGATGCAGTGGGAGCGCGAGATCTCCAACTACACCGAGATCATCTACG
AGCTCCTCGAGGAGTCCCAGAACCAGCAGGAGAAGAACGAGCAGGATCTGCTCGCGCTGGACCGCTGGAACTCCCTGTG
GAACTGGTTCAACATCACCAACTGGCTGTGGTACATCAAGATCTTCATCATGATCGTGGGCGGCCTGATCGGCCTGCGC
ATCATCTTCGCCGTGCTGTCGCTGGTGAACCGCGTGCGCCAGGGCTGATGAGgtgaccgaattcgggacccggatcc

Figure 2A cont.

>HV1300662, CH505.M11gp145 (SEQ ID NO. 79)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCATGTGGGTGACGGTGTACTACGGCGTGCCGGTGTGGAAGGAGGCCAAGACGACC
CTGTTCTGCGCGTCGGACGCCAAGGCCTACGAGAAGGAGGTGCACAACGTGTGGGCGACCCACGCCTGCGTGCCCACGG
ACCCCAACCCGCAGGAGATGGTGCTGAAGAACGTGACCGAGAACTTCAACATGTGGAAGAACGACATGGTGGACCAGAT
GCACGAGGACGTGATCTCCCTGTGGGACCAGTCCCTGAAGCCCTGCGTGAAGCTGACCCCGCTGTGCGTGACCCTGAAC
TGCACCAACGCCACCGCGTCCAACTCCTCCATCATCGAGGGCATGAAGAACTGCTCCTTCAACATCACGACGGAGCTGC
GCGACAAGCGCGAGAAGAAGAACGCCCTGTTCTACAAGCTGGACATCGTGCAGCTGGACGGCAACTCCTCGCAGTACAG
GCTGATCAACTGCAACACCTCCGTCATCACGCAGGCGTGCCCCAAGGTGTCCTTCGACCCCATCCCCATCCACTACTGC
GCCCCCGCCGGCTACGCCATCCTGAAGTGCAACAACAAGACCTTCACCGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCAT
CATCCGGTCCGAGAACATCACGGACAACGGGAAGACCATCATCGTGCACCTGAACGAGTCCGTGAAGATCGAGTGCACC
CGCCCGAACAACAAGACGCGCACCTCCATCCGGATCGGCCCTGGCCAGGCCTTCTACGCCACCGGCCAGGTGATCGGCG
ACATCCGCGAGGCGTACTGCAACATCAACGAGTCCAAGTGGAACGAGACCCTGCAGCGCGTGTCCAAGAAGCTGAAGGA
GTACTTCCCCCACAAGAACATCACCTTCCAGCCGTCGTCCGGCGGCGACCTCGAGATCACCACGCACTCCTTCAACTGC
GGTGGCGAGTTCTTCTACTGCAACACGTCGTCGCTGTTCAACCGCACCTACATGGCCAACTCCACCGACATGGCCAACT
CCACCGAGACCAACTCCACGCGCACCATCACGATCCACTGCCGCATCAAGCAGATCATCAACATGTGGCAGGAGGTGGG
CCGCGCCATGTACGCACCGCCCATCGCCGGCAACATCACCTGCATCTCCAACATCACCGGCCTCCTGCTGACCCGCGAC
GGCGGCAAGAACAACACGGAGACCTTCAGGCCAGGCGGAGGCAACATGAAGGACAACTGGCGCTCCGAGCTGTACAAGT
ACAAGGTGGTGGAGGTGAAGCCCCTGGGCGTGGCACCCACCAACGCCCGCAGGCGCGTCGTGGAGCGCGAGAAGCGCGC
CGTGGGCATGGGCGCCGTGTTCCTGGGCTTCCTGGGCGCTGCGGGCTCCACCATGGGTGCCGCGTCCATCACCCTGACC
GTGCAGGCCCGCCAGCTGCTCTCCGGCATCGTGCAGCAGCAGTCCAACCTCCTGAAGGCCATCGAGGCCCAGCAGCACA
TGCTGAAGCTGACCGTGTGGGGCATCAAGCAGCTGCAGGCCAGGGTGCTCGCGCTCGAGCGCTACCTGAAGGACCAGCA
GCTGCTCGGCATGTGGGGCTGCTCCGGCAAGCTGATCTGCACCACCAACGTGTACTGGAACTCGTCCTGGTCCAACAAG
ACCTACGGCGACATCTGGGACAACATGACCTGGATGCAGTGGGAGCGCGAGATCTCCAACTACACCGAGATCATCTACG
AGCTCCTCGAGGAGTCCCAGAACCAGCAGGAGAAGAACGAGCAGGATCTGCTCGCGCTGGACCGCTGGAACTCCCTGTG
GAACTGGTTCAACATCACCAACTGGCTGTGGTACATCAAGATCTTCATCATGATCGTGGGCGGCCTGATCGGCCTGCGC
ATCATCTTCGCCGTGCTGTCGCTGGTGAACCGCGTGCGCCAGGGCTGATGAGgtgaccgaattcaggtcccggatcc

Figure 2A cont.

>HV1300635, CH505w020.14gp145 (SEQ ID NO. 80)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCATGTGGGTGACGGTGTACTACGGCGTGCCGGTGTGGAAGGAGGCCAAGACGACC
CTGTTCTGCGCGTCGGACGCCAAGGCCTACGAGAAGGAGGTGCACAACGTGTGGGCGACCCACGCCTGCGTGCCCACGG
ACCCCAACCCGCAGGAGATGGTGCTGAAGAACGTGACCGAGAACTTCAACATGTGGAAGAACGACATGGTGGACCAGAT
GCACGAGGACGTGATCTCCCTGTGGGACCAGTCCCTGAAGCCCTGCGTGAAGCTGACCCCGCTGTGCGTGACCCTGAAC
TGCACCAACGCCACCGCGTCCAACAACTCCATCATCGAGGGCATGAAGAACTGCTCCTTCAACATCACGACGGAGCTGC
GCGACAAGCGCGAGAAGAAGAACGCCCTGTTCTACAAGCTGGACATCGTGCAGCTGGACGGCAACTCCTCGCAGTACAG
GCTGATCAACTGCAACACCTCCGTCATCACGCAGGCGTGCCCCAAGGTGTCCTTCGACCCCATCCCCATCCACTACTGC
GCCCCCGCCGGCTACGCCATCCTGAAGTGCAACAACAAGACCTTCACCGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCAT
CATCCGGTCCGAGAACATCACGAACAACGCGAAGACCATCATCGTGCACCTGAACGAGTCCGTGAAGATCGAGTGCACC
CGCCCGAACAACAAGACGCGCACGTCCATCCGGATCGGCCCTGGCCAGGCCTTCTACGCCACCGGCCAGGTGATCGGCG
ACATCCGCAAGGCGTACTGCAACATCTCGGAGTCCAAGTGGAACGAGACCCTGCAGCGCGTGTCCAAGAAGCTGAAGGA
GTACTTCCCCCACAAGAACATCACCTTCCAGCCGTCGTCCGGCGGCGACCTCGAGATCACCACGCACTCCTTCAACTGC
GGTGGCGAGTTCTTCTACTGCAACACGTCGTCGCTGTTCAACCGCACCTACATGGCCAACTCCACCGACATGGCCAACT
CCACCGAGACCAACTCCACGCGCACCATCACGCTCCACTGCCGCATCAAGCAGATCATCAACATGTGGCAGGAGGTGGG
CCGCGCCATGTACGCACCGCCCATCGCCGGCAACATCACCTGCATCTCCAACATCACCGGCCTCCTGCTGACCCGCGAC
GGCGGCAAGAACAACACGGAGACCTTCAGGCCAGGCGGAGGCAACATGAAGGACAACTGGCGCTCCGAGCTGTACAAGT
ACAAGGTGGTGGAGGTGAAGCCCCTGGGCGTGGCACCCACCAACGCCCGCAGGCGCGTCGTGGAGCGCGAGAAGCGCGC
CGTGGGCATGGGCGCCGTGTTCCTGGGCTTCCTGGGCGCTGCGGGCTCCACCATGGGTGCCGCGTCCATCACCCTGACC
GTGCAGGCCCGCCAGCTGCTCTCCGGCATCGTGCAGCAGCAGTCCAACCTCCTGAAGGCCATCGAGGCCCAGCAGCACA
TGCTGAAGCTGACCGTGTGGGGCATCAAGCAGCTGCAGGCCAGGGTGCTCGCGCTCGAGCGCTACCTGAAGGACCAGCA
GCTGCTCGGCATGTGGGGCTGCTCCGGCAAGCTGATCTGCACCACCAACGTGTACTGGAACTCGTCCTGGTCCAACAAG
ACCTACGGCGACATCTGGGACAACATGACCTGGATGCAGTGGGAGCGCGAGATCTCCAACTACACCGAGATCATCTACG
AGCTCCTCGAGGAGTCCCAGAACCAGCAGGAGAAGAACGAGCAGGATCTGCTCGCGCTGGACCGCTGGAACTCCCTGTG
GAACTGGTTCAACATCACCAACTGGCTGTGGTACATCAAGATCTTCATCATGATCGTGGGCGGCCTGATCGGCCTGCGC
ATCATCTTCGCCGTGCTGTCGCTGGTGAACCGCGTGCGCCAGGGCTGATGAGggacccgaattcggtcaccggatcc

Figure 2A cont.

>HV1300636, CH505w030.28gp145 (SEQ ID NO. 81)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCATGTGGGTGACGGTGTACTACGGCGTGCCGGTGTGGAAGGAGGCCAAGACGACC
CTGTTCTGCGCGTCGGACGCCAAGGCCTACGAGAAGGAGGTGCACAACGTGTGGGCGACCCACGCCTGCGTGCCCACGG
ACCCCAACCCGCAGGAGATGGTGCTGAAGAACGTGACCGAGAACTTCAACATGTGGAAGAACGACATGGTGGACCAGAT
GCACGAGGACGTGATCTCCCTGTGGGACCAGTCCCTGAAGCCCTGCGTGAAGATGACCCCGCTGTGCGTGACCCTGAAC
TGCACCAACGCCACCGCGATCAACTCCTCCATCATCGAGGGCATGAAGAACTGCTCCTTCAACATCACGACGGAGCTGC
GCGACAAGCGCGAGAAGAAGAACGCCCTGTTCTACAAGCTGGACATCGTGCAGCTGGACGGCAACTCCTCGCAGTACAG
GCTGATCAACTGCAACACCTCCGTCATCACGCAGGCGTGCCCCAAGGTGTCCTTCGACCCCATCCCCATCCACTACTGC
GCCCCCGCCGGCTACGCCATCCTGAAGTGCAACAACAAGACCTTCACCGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCAT
CATCCGGTCCGAGAACATCACGAACAACGACAAGACCATCATCGTGCACCTGAACGAGTCCGTGAAGATCGAGTGCACC
CGCCCGAACAACAAGACGCGCACCTCCATCCGGATCGGCCCTGGCCAGGCCTTCTACGCCACCGGCCAGGTGATCGGCG
ACATCCGCGAGGCGCACTGCAACATCTCGGAGTCCAAGTGGAACGAGACCCTGCAGCGCGTGTCCAAGAAGCTGAAGGA
GTACTTCCCCCACAAGAACATCACCTTCCAGCCGTCGTCCGGCGGCGACCTCGAGATCACCACGCACTCCTTCAACTGC
GGTGGCGAGTTCTTCTACTGCAACACGTCGTCGCTGTTCAACCGCACCTACATGGCCAACTCCACCGACATGGCCAACT
CCACCGAGACCAACTCCACGCGCACCATCACGATCCGCTGCCGCATCAAGCAGATCATCAACATGTGGCAGGAGGTGGG
CCGCGCCATGTACGCACCGCCCATCGCCGGCAACATCACCTGCATCTCCAACATCACCGGCCTCCTGCTGACCCGCGAC
GGCGGCAAGAACAACACGGAGACCTTCAGGCCAGGCGGAGGCAACATGAAGGACAACTGGCGCTCCGAGCTGTACAAGT
ACAAGGTGGTGGAGGTGAAGCCCCTGGGCGTGGCACCCACCAACGCCCGCAGGCGCGTCGTGGAGCGCGAGAAGCGCGC
CGTGGGCATGGGCGCCGTGTTCCTGGGCTTCCTGGGCGCTGCGGGCTCCACCATGGGTGCCGCGTCCATCACCCTGACC
GTGCAGGCCCGCCAGCTGCTCTCCGGCATCGTGCAGCAGCAGTCCAACCTCCTGAAGGCCATCGAGGCCCAGCAGCACA
TGCTGAAGCTGACCGTGTGGGGCATCAAGCAGCTGCAGGCCAGGGTGCTCGCGCTCGAGCGCTACCTGAAGGACCAGCA
GCTGCTCGGCATGTGGGGCTGCTCCGGCAAGCTGATCTGCACCACCAACGTGTACTGGAACTCGTCCTGGTCCAACAAG
AGCTACGGCGACATCTGGGACAACATGACCTGGATGCAGTGGGAGCGCGAGATCTCCAACTACACCGAGATCATCTACG
AGCTCCTCGAGGAGTCCCAGAACCAGCAGGAGAAGAACGAGCAGGATCTGCTCGCGCTGGACCGCTGGAACTCCCTGTG
GAACTGGTTCAACATCACCAACTGGCTGTGGTACATCAAGATCTTCATCATGATCGTGGGCGGCCTGATCGGCCTGCGC
ATCATCTTCGCCGTGCTGTCGCTGGTGAACCGCGTGCGCCAGGGCTGATGAGggtcctgaattcggttaccggatcc

Figure 2A cont.

>HV1300639, CH505w078.15gp145 (SEQ ID NO. 82)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCATGTGGGTGACGGTGTACTACGGCGTGCCGGTGTGGAAGGAGGCCAAGACGACC
CTGTTCTGCGCGTCGGACGCCAAGGCCTACGAGAAGGAGGTGCACAACGTGTGGGCGACCCACGCCTGCGTGCCCACGG
ACCCCAACCCGCAGGAGATGGTGCTGAAGAACGTGACCGAGAACTTCAACATGTGGAAGAACGACATGGTGGACCAGAT
GCACGAGGACGTGATCTCCCTGTGGGACCAGTCCCTGAAGCCCTGCGTGAAGCTGACCCCGCTGTGCGTGACCCTGAGC
TGCACGAACGCCACCAACGCGACGGCGTCGAACTCGTCCATCCTCGAGGGGATGAAGAACTGCTCCTTCAACATCACGA
CGGAGCTGCGCGACAAGCGCGAGAAGAAGAACGCCCTGTTCTACAAGCTGGACATCGTGCAGCTGGACGGCAACTCCTC
GCAGTACAGGCTGATCAACTGCAACACCTCCGTCATCACGCAGGCGTGCCCCAAGGTGTCCTTCGACCCCATCCCCATC
CACTACTGCGCCCCCGCCGGCTACGCCATCCTGAAGTGCAACAACAAGACCTTCAACGGCACCGGCCCGTGCAACAACG
TGTCCACCGTGCAGTGCACGCACGGGATCAAGCCCGTGGTGTCCACGCAGCTGCTCCTGAACGGGTCGCTGGCCGAGGG
CGAGATCATCATCCGGTCGAAGAACATCACGGACAACGGGAAGACCATCATCGTGCACCTGAACGAGTCCGTGAAGATC
GAGTGCACCCGCCCGAGCAACAACACGCGCACCTCCATCCGGATCGGCCCTGGCCAGGCCTTCTACGCCACCGGCCAGG
TGATCGGCGACATCCGCGAGGCGCACTGCAACATCTCCGAGTCCAAGTGGAACGAGACCCTGCAGCGCGTGTCCGAGAA
GCTGAAGGAGTACTTCCCCCACAAGAACATCACCTTCCAGCCGTCGTCCGGCGGCGACCTCGAGATCACCACGCACTCC
TTCAACTGCGGTGGCGAGTTCTTCTACTGCAACACGTCGTCGCTGTTCAACCGCACCTACATGGCCACCTCCACCGACA
TGGCCAACTCCACCGAGACCAACTCCACGCGCATCATCACGATCCGCTGCCGCATCAAGCAGATCATCAACATGTGGCA
GGAGGTGGGCCGCGCCATGTACGCACCGCCCATCGCCGGCAACATCACCTGCATCTCCAACATCACCGGCCTCCTGCTG
ACCCGCGACGGCGGCAAGAACGACACGGACACCTTCAGGCCAGAGGGAGGCAACATGAAGGACAACTGGCGCTCCGAGC
TGTACAAGTACAAGGTGGTGGAGGTGAAGCCCCTGGGCGTGGCACCCACCAACGCCCGCAGGCGCGTCGTGGAGCGCGA
GAAGCGCGCCGTGGGCATGGGCGCCGTGTTCCTGGGCTTCCTGGGCGCTGCGGGCTCCACCATGGGTGCCGCGTCCATC
ACCCTGACCGTGCAGGCCCGCCAGCTGCTCTCCGGCATCGTGCAGCAGCAGTCCAACCTCCTGAAGGCCATCGAGGCCC
AGCAGCACATGCTGAAGCTGACCGTGTGGGGCATCAAGCAGCTGCAGGCCAGGGTGCTCGCGCTCGAGCGCTACCTGAA
GGACCAGCAGCTGCTCGGCATGTGGGGCTGCTCCGGCAAGCTGATCTGCACCACCAACGTGTACTGGAACTCGTCCTGG
TCCAACAAGACCTACGGCGACATCTGGGACAACATGACCTGGATGCAGTGGGAGCGCGAGATCTCCAACTACACCGAGC
TGATCTACGAGCTCCTCGAGGAGTCCCAGAACCAGCAGGAGAAGAACGAGCAGGATCTGCTCGCGCTGGACCGCTGGAA
CTCCCTGTGGAACTGGTTCAACATCACCAACTGGCTGTGGTACATCAAGATCTTCATCATGATCGTGGGCGGCCTGATC
GGCCTGCGCATCATCTTCGCCGTGCTGTCGCTGGTGAACCGCGTGCGCCAGGGCTGATGAGaattcggtcaccgggtcc
tggatcc

Figure 2A cont.

>HV1300696, CH505w53.16gp145 (SEQ ID NO. 83)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCATGTGGGTGACGGTGTACTACGGCGTGCCGGTGTGGAAGGAGGCCAAGACGACC
CTGTTCTGCGCGTCGGACGCCAAGGCCTACGAGAAGGAGGTGCACAACGTGTGGGCGACCCACGCCTGCGTGCCCACGG
ACCCCAACCCGCAGGAGATGGTGCTGAAGAACGTGACCGAGAACTTCAACATGTGGAAGAACGACATGGTGGACCAGAT
GCACGAGGACGTGATCTCCCTGTGGGACCAGTCCCTGAAGCCCTGCGTGAAGCTGACCCCGCTGTGCGTGACCCTGAAC
TGCACCAACGCGAACGCCACCGCGTCCAACTCCTCTATCATCGAGGGGATGAACTCCTCCATCATCGAGGGCATGAAGA
ACTGCTCCTTCAACATCACGACGGAGCTGCGCGACAAGCGCGAGAAGAAGAACGCCCTGTTCTACAAGCTGGACATCGT
GCAGCTGGACGGCAACTCCTCGCAGTACAGGCTGATCAACTGCAACACCTCCGTCATCACGCAGGCGTGCCCCAAGGTG
TCCTTCGACCCCATCCCCATCCACTACTGCGCCCCCGCCGGCTACGCCATCCTGAAGTGCAACAACAAGACCTTCAACG
GCACCGGCCCGTGCAACAACGTGTCCACCGTGCAGTGCACGCACGGGATCAAGCCCGTGGTGTCCACGCAGCTGCTCCT
GAACGGGTCGCTGGCCGAGGGCGAGATCATCATCCGGTCCGAGAACATCACGGACAACGGGAAGACCATCATCGTGCAC
CTGAACGAGTCCGTGAAGATCGAGTGCACCCGCCCGAGCAACAACACGCGCACCTCCATCCGGATCGGCCCTGGCCAGG
CCTTCTACGCCACCGGCCAGGTGATCGGCGACATCCGCGAGGCGCACTGCAACATCTCGGAGTCCAAGTGGAACGAGAC
CCTGCAGCGCGTGTCCGAGAAGCTGAAGGAGTACTTCCCCCACAAGAACATCACCTTCCAGCCGTCGTCCGGCGGCGAC
CTCGAGATCACCACGCACTCCTTCAACTGCGGTGGCGAGTTCTTCTACTGCAACACGTCGTCGCTGTTCAACCGCACCT
ACATGGCCACGTCCACCGACATGGCCAACTCCACCGAGACCAACTCCACGCGCATCATCACGATCCGGTGCCGCATCAA
GCAGATCATCAACATGTGGCAGGAGGTGGGCCGCGCCATGTACGCACCGCCCATCGCCGGCAACATCACCTGCATCTCC
AACATCACCGGCCTCCTGCTGACCCGCGACGGCGGCAAGAACAACACGGAGACCTTCGAGACGTTCAGGCCAGGCGGAG
GCAACATGAAGGACAACTGGCGCTCCGAGCTGTACAAGTACAAGGTGGTGGAGGTGAAGCCCCTGGGCGTGGCACCCAC
CAACGCCCGCAGGCGCGTCGTGGAGCGCGAGAAGCGCGCCGTGGGCATGGGCGCCGTGTTCCTGGGCTTCCTGGGCGCT
GCGGGCTCCACCATGGGTGCCGCGTCCATCACCCTGACCGTGCAGGCCCGCCAGCTGCTCTCCGGCATCGTGCAGCAGC
AGTCCAACCTCCTGAAGGCCATCGAGGCCCAGCAGCACATGCTGAAGCTGACCGTGTGGGGCATCAAGCAGCTGCAGGC
CAGGGTGCTCGCGCTCGAGCGCTACCTGAAGGACCAGCAGCTGCTCGGCATGTGGGGCTGCTCCGGCAAGCTGATCTGC
ACCACCAACGTGTACTGGAACTCGTCCTGGTCCAACAAGACCTACGGCGACATCTGGGACAACATGACCTGGATGCAGT
GGGAGCGCGAGATCTCCAACTACACCGAGATCATCTACGAGCTCCTCGAGGAGTCCCAGAACCAGCAGGAGAAGAACGA
GCAGGATCTGCTCGCGCTGGACCGCTGGAACTCCCTGTGGAACTGGTTCAACATCACCAACTGGCTGTGGTACATCAAG
ATCTTCATCATGATCGTGGGCGGCCTGATCGGCCTGCGCATCATCTTCGCCGTGCTGTCGCTGGTGAACCGCGTGCGCC
AGGGCTGATGAGaattcggtgaccgggtcccggatccagatctgctgtgcctt

Figure 2A cont.

>HV1300689, CH505w30.21gp145 (SEQ ID NO. 84)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCATGTGGGTGACGGTGTACTACGGCGTGCCGGTGTGGAAGGAGGCCAAGACGACC
CTGTTCTGCGCGTCGGACGCCAAGGCCTACGAGAAGGAGGTGCACAACGTGTGGGCGACCCACGCCTGCGTGCCCACGG
ACCCCAACCCGCAGGAGATGGTGCTGAAGAACGTGACCGAGAACTTCAACATGTGGAAGAACGACATGGTGGACCAGAT
GCACGAGGACGTGATCTCCCTGTGGGACCAGTCCCTGAAGCCCTGCGTGAAGCTGACCCCGCTGTGCGTGACCCTGAAC
TGCACCAACGCGACGACGAACGCCACCGCGTCCAACTCGTCCATCATCGAGGAGATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTC
CTCGCAGTACAGGCTGATCAACTGCAACACCTCCGTCATCACGCAGGCGTGCCCCAAGGTGTCCTTCGACCCCATCCCC
ATCCACTACTGCGCCCCCGCCGGCTACGCCATCCTGAAGTGCAACAACAAGACCTTCACCGGCACCGGCCCGTGCAACA
ACGTGTCCACCGTGCAGTGCACGCACGGGATCAAGCCCGTGGTGTCCACGCAGCTGCTCCTGAACGGGTCGCTGGCCGA
GGGCGAGATCATCATCCGGTCCGAGAACATCACGAACACGGCGAAGACCATCATCGTGCACCTGAACGAGTCCGTGAAG
ATCGAGTGCACCCGCCCGAACAACAAGACGCGCACCTCCATCCGGATCGGCCCTGGCCAGGCCTTCTACGCCACCGGCC
AGGTGATCGGCGACATCCGCGAGGCGTACTGCAACATCTCGGAGTCCAAGTGGAACGAGACCCTGCAGCGCGTGTCCAA
GAAGCTGAAGGAGTACTTCCCCCACAAGAACATCACCTTCCAGCCGTCGTCCGGCGGCGACCTCGAGATCACCACGCAC
TCCTTCAACTGCGGTGGCGAGTTCTTCTACTGCAACACGTCGTCGCTGTTCAACCGCACCTACATGGCCAACTCCACCG
ACATGGCCAACTCCACCGAGACCAACTCCACGCGCACCATCACGATCCGGTGCCGCATCAAGCAGATCATCAACATGTG
GCAGGAGGTGGGCCGCGCCATGTACGCACCGCCCATCGCCGGCAACATCACCTGCATCTCCAACATCACCGGCCTCCTG
CTGACCCGCGACGGCGGCGAGAACAACACGGAGACCTTCAGGCCAGGCGGAGGCAACATGAAGGACAACTGGCGCTCCG
AGCTGTACAAGTACAAGGTGGTGGAGGTGAAGCCCCTGGGCGTGGCACCCACCAACGCCCGCAGGCGCGTCGTGGAGCG
CGAGAAGCGCGCCGTGGGCATGGGCGCCGTGTTCCTGGGCTTCCTGGGCGCTGCGGGCTCCACCATGGGTGCCGCGTCC
ATCACCCTGACCGTGCAGGCCCGCCAGCTGCTCTCCGGCATCGTGCAGCAGCAGTCCAACCTCCTGAAGGCCATCGAGG
CCCAGCAGCACATGCTGAAGCTGACCGTGTGGGGCATCAAGCAGCTGCAGGCCAGGGTGCTCGCGCTCGAGCGCTACCT
GAAGGACCAGCAGCTGCTCGGCATGTGGGGCTGCTCCGGCAAGCTGATCTGCACCACCAACGTGTACTGGAACTCGTCC
TGGTCCAACAAGACCTACGGCGACATCTGGGACAACATGACCTGGATGCAGTGGGAGCGCGAGATCTCCAACTACACCG
AGATCATCTACGAGCTCCTCGAGGAGTCCCAGAACCAGCAGGAGAAGAACGAGCAGGATCTGCTCGCGCTGGACCGCTG
GAACTCCCTGTGGAACTGGTTCAACATCACCAACTGGCTGTGGTACATCAAGATCTTCATCATGATCGTGGGCGGCCTG
ATCGGCCTGCGCATCATCTTCGCCGTGCTGTCGCTGGTGAACCGCGTGCGCCAGGGCTGATGAGggtcccgaattcggt
taccggatccagatctgctgtgcctt

Figure 2A cont.

>HV1300705, CH505w78.33gp145 (SEQ ID NO. 85)

gtcgacaagaagccaccATGCGCGTGACGGGCATCCAGCGCAACTACCCGCAGTGGTGGATCTGGTCGATGCTGGGCCT
CTGGATGCTCATGATCTGCAACGGCATGTGGGTGACGGTGTACTACGGCGTGCCGGTGTGGAAGGAGGCCAAGACGACC
CTGTTCTGCGCGTCGGACGCCAAGGCCTACGAGAAGGAGGTGCACAACGTGTGGGCGACCCACGCCTGCGTGCCCACGG
ACCCCAACCCGCAGGAGATGGTGCTGAAGAACGTGACCGAGAACTTCAACATGTGGAAGAACGACATGGCGGACCAGAT
GCACGAGGACGTGATCTCCCTGTGGGACCAGTCCCTGAAGCCCTGCGTGAAGCTGACCCCGCTGTGCGTGACCCTGAAC
TGCATCGACGCCAACGCGACCGCGTCCAACGCGACGGCATCCAACTCGTCCATCATCGAGGGGATGAAGAACTGCTCCT
TCAACATCACGACGGAGCTGCGCGACAAGATCGAGAAGAAGAACGCCCTGTTCTACAAGCTGGACATCGTGCAGCTGGA
CGGCAACTCCTCGCAGTACAGGCTGATCAACTGCAACACCTCCGTCATCACGCAGGCGTGCCCCAAGGTGTCCTTCGAC
CCCATCCCCATCCACTACTGCGCCCCCGCCGGCTACGCCATCCTGAAGTGCAACAACAAGACCTTCAACGGCACCGGCC
CGTGCAACAACGTGTCCACCGTGCAGTGCACGCACGGGATCAAGCCCGTGGTGTCCACGCAGCTGCTCCTGAACGGGTC
GCTGGCCGAGGGCGAGATCATCATCCGGTCGGAGAACATCACGAACAGCGCGAAGACCATCATCGTGCACCTGAACGAG
TCCGTGAAGATCGAGTGCACCCGCCCGAGCAACAACACGCGCACCTCCATCCGGATCGGCCCTGGCCAGGCCTTCTACG
CCACCGGCCAGGTGATCGGCGACATCCGCAAGGCGCACTGCAACATCTCCGAGTCCAAGTGGAACGAGACCCTGCAGCG
CGTGTCCAAGAAGCTGAAGGAGTACTTCCCCCACAAGAACATCACCTTCCAGCCGTCGTCCGGCGGCGACCTCGAGATC
ACCACGCACTCCTTCAACTGCGGTGGCGAGTTCTTCTACTGCAACACGTCGTCGCTGTTCAACCGCACCTACATGGCCA
ACTCCACCGAGACCAACTCCACGCGCACGATCACGCTCCACTGCCGCATCAAGCAGATCATCAACATGTGGCAGGAGGT
GGGCCGCGCCATGTACGCACCGCCCATCGCCGGCAACATCACCTGCATCTCCAACATCACCGGCCTCCTGCTGACCCGC
GACGGCGGCAACAACAACACCACGGAGACCTTCAGGCCAGGGGGAGGCAACATGAAGGACAACTGGCGCTCCGAGCTGT
ACAAGTACAAGGTGGTGGAGATCAAGCCCCTGGGCGTGGCACCCACCAACGCCCGCAGGCGCGTCGTGGAGCGCGAGAA
GCGCGCCGTGGGCATGGGCGCCGTGTTCCTGGGCTTCCTGGGCGCTGCGGGCTCCACCATGGGTGCCGCGTCCATCACC
CTGACCGTGCAGGCCCGCCAGCTGCTCTCCGGCATCGTGCAGCAGCAGTCCAACCTCCTGAAGGCCATCGAGGCCCAGC
AGCACATGCTGAAGCTGACCGTGTGGGGCATCAAGCAGCTGCAGGCCAGGGTGCTCGCGCTCGAGCGCTACCTGAAGGA
CCAGCAGCTGCTCGGCATGTGGGGCTGCTCCGGCAAGCTGATCTGCACCACCAACGTGTACTGGAACTCGTCCTGGTCC
AACAAGACCTACGGCGACATCTGGGACAACATGACCTGGATGCAGTGGGAGCGCGAGATCTCCGACTACACCGAGATCA
TCTACGAGCTCCTCGAGGAGTCCCAGAACCAGCAGGAGAAGAACGAGCAGGATCTGCTCGCGCTGGACCGCTGGAACTC
CCTGTGGAACTGGTTCAACATCACCAACTGGCTGTGGTACATCAAGATCTTCATCATGATCGTGGGCGGCCTGATCGGC
CTGCGCATCATCTTCGCCGTGCTGTCGCTGGTGAACCGCGTGCGCCAGGGCTGATGAGaattcggtaaccaggtcccgg
atccagatctgctgtgcctt

Figure 2A cont.

>HV1300714, CH505w100.B6gp145 (SEQ ID NO. 86)

gtcgacaagaagccaccATGAAGGTGCGGGGCATCCAGCGCAACTACCCGCAGTGGTGGATCTGGTCGATGCTGGGCCT
CTGGATGCTCATGATCTGCAACGGCATGTGGGTGACGGTGTACTACGGCGTGCCGGTGTGGAAGGAGGCCAAGACGACC
CTGTTCTGCGCGTCGGACGCCAAGGCCTACGAGAAGGAGGTGCACAACGTGTGGGCGACCCACGCCTGCGTGCCCACGG
ACCCCAACCCGCAGGAGATGGTGCTGGAGAACGTGACCGAGAACTTCAACATGTGGAAGAACGACATGGCGGACCAGAT
GCACGAGGACGTGATCTCCCTGTGGGACCAGTCCCTGAAGCCCTGCGTGAAGCTGACCCCGCTGTGCGTGACCCTGAAC
TGCACGGACGCCAACGCCACCGCGTCGAACACCAACGCGACCGCAAGCAACATCAACGCGACGGCGTCGAAGTCCTCCA
TCATCGAGGAGATGAAGAACTGCTCCTTCAACATCACGACGGAGCTGCGCGACAAGCGCGAGAAGAAGTACGCCCTGTT
CTACAAGCTGGACATCGTGCAGCTGGACGGCAACTCCTCGCAGTACAGGCTGATCAACTGCAACACCTCCGTCATCACG
CAGGCGTGCCCCAAGGTGTCCTTCGACCCCATCCCCATCCACTACTGCGCCCCCGCCGGCTACGCCATCCTGAAGTGCA
ACAACAAGACCTTCAACGGCACCGGCCCGTGCAACAACGTGTCCACCGTGCAGTGCACGCACGGGATCAAGCCCGTGGT
GTCCACGCAGCTGCTCCTGAACGGGTCGCTGGCCGAGGGCGAGATCATCATCCGGTCGGAGAACATCACGGACAACAGC
AAGACCATCATCGTGCACCTGAACGAGTCCGTGAAGATCGAGTGCACCCGCCCGAGCAACAACACGCGCACCTCCATCC
GGATCGGCCCTGGCCAGGCCTTCTACGCCACCGGCCAAGTGATCGGCGACATCCGCGAGGCGCACTGCAACATCTCCGA
GTCCAAGTGGAACGAGACCCTGCAGCGCGTGTCCAAGAAGCTGAAGGAGTACTTCCCCGACAAGAACATCACCTTCCAG
CCGTCGTCCGGCGGCGACCCCGAGATCACCACGCACTCCTTCAACTGCGGTGGCGAGTTCTTCTACTGCAACACGTCGT
CCCTGTTCAACCGCACCTACATGGCGAACTCCACCGAGACCAACTCCACGCGCACCATCACGCTGCACTGCCGCATCAA
GCAGATCATCAACATGTGGCAGGAGGTGGGCCGCGCCATGTACGCACCGCCCATCGCCGGCAACATCACCTGCATCTCC
AACATCACCGGCCTCCTGCTGACCCGCGACGGCGGCGAGAACACCCGGGACGGAGGCAACAACAACACGGAGACCTTCA
GGCCAGAGGGAGGCAACATGAAGGACAACTGGCGCTCCGAGCTGTACAAGTACAAGGTGGTGGAGGTGAAGCCCCTGGG
CGTGGCACCCACCAAGGCCCGCAGGCGCGTCGTGGAGCGCGAGAAGCGCGCCGTGGGCATGGGCGCCGTGTTCCTGGGC
TTCCTGGGCGCTGCGGGCTCCACCATGGGTGCCGCGTCCATCACCCTGACCGTGCAGGCCCGCCAGCTGCTCTCCGGCA
TCGTGCAGCAGCAGTCCAACCTCCTGAAGGCCATCGAGGCCCAGCAGCACATGCTGAAGCTGACCGTGTGGGGCATCAA
GCAGCTGCAGGCCAGGGTGCTCGCGCTCGAGCGCTACCTGAAGGACCAGCAGCTGCTCGGCATGTGGGGCTGCTCCGGC
AAGCTGATCTGCACCACCAACGTGTACTGGAACTCGTCCTGGTCCAACAAGACCTACGGCGACATCTGGGACAACATGA
CCTGGATGCAGTGGGAGCGCGAGATCTCCAACTACACCGACATCATCTACGACCTCCTCGAGGAGTCCCAGAACCAGCA
GGAGAAGAACGAGCAGGATCTGCTCGCGCTGGACCGCTGGAACTCCCTGTGGAACTGGTTCAACATCACCAAGTGGCTG
TGGTACATCAAGATCTTCATCATGATCGTGGGCGGCCTGATCGGCCTGCGCATCATCTTCGCCGTGCTGTCGCTGGTGA
ACCGCGTGCGCCAGGGCTGATGAGgtaaccgggacccgaattcggatccagatctgctgtgcctt

Figure 2A cont.

>HV1300638, CH505w053.31gp145 (SEQ ID NO. 87)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCATGTGGGTGACGGTGTACTACGGCGTGCCGGTGTGGAAGGAGGCCAAGACGACC
CTGTTCTGCGCGTCGGACGCCAAGGCCTACGAGAAGGAGGTGCACAACGTGTGGGCGACCCACGCCTGCGTGCCCACGG
ACCCCAACCCGCAGGAGATGGTGCTGAAGAACGTGACCGAGAACTTCAACATGTGGAAGAACGACATGGTGGACCAGAT
GCACGAGGACGTGATCTCCCTGTGGGACCAGTCCCTGAAGCCCTGCGTGAAGCTGACCCCGCTGTGCGTGACCCTGAAC
TGCACCGACGCCACCGCGTCCAACGCAACCGCGAGCAACGCCACGGCGTCGAACTCCTCCATCATCGAGGGCATGAAGA
ACTGCTCCTTCAACATCACGACGGAGCTGCGCGACAAGCGCGAGAAGAAGAACGCCCTGTTCTACAAGCTGGACATCGT
GCAGCTGGACGGCAACTCCTCGCAGTACAGGCTGATCAACTGCAACACCTCCGTCATCACGCAGGCGTGCCCCAAGGTG
TCCTTCGACCCCATCCCCATCCACTACTGCGCCCCCGCCGGCTACGCCATCCTGAAGTGCAACAACAAGACCTTCAACG
GCACCGGCCCGTGCAACAACGTGTCCACCGTGCAGTGCACGCACGGGATCAAGCCCGTGGTGTCCACGCAGCTGCTCCT
GAACGGGTCGCTGGCCGAGGGCGAGATCATCATCCGGTCCGAGAACATCACGGACAACGGGAAGACCATCATCGTGCAC
CTGAACGAGTCCGTGAAGATCGAGTGCACCCGCCCGTCGAACAACACGCGCACCTCCATCCGGATCGGCCCTGGCCAGG
CCTTCTACGCCACCGGCCAGGTGATCGGCGACATCCGCGAGGCGCACTGCAACATCTCGGAGTCCAAGTGGAACGAGAC
CCTGCAGCGCGTGTCCAAGAAGCTGAAGGAGTACTTCCCCCACAAGAACATCACCTTCCAGCCGTCGTCCGGCGGCGAC
CTCGAGATCACCACGCACTCCTTCAACTGCGGTGGCGAGTTCTTCTACTGCAACACGTCGTCGCTGTTCAACCGCACCT
ACATGGCCAACTCCACCGAGACCAACTCCACGCGCATCATCACGATCCGCTGCCGCATCAAGCAGATCATCAACATGTG
GCAGGAGGTGGGCCGCGCCATGTACGCACCGCCCATCGCCGGCAACATCACCTGCATCTCCAACATCACCGGCCTCCTG
CTGACCCGCGACGGCGGCAACAACAACACGGAGACCTTCAGGCCAGGCGGAGGCAACATGAAGGACAACTGGCGCTCCG
AGCTGTACAAGTACAAGGTGGTGGAGGTGAAGCCCCTGGGCGTGGCACCCACCAACGCCCGCAGGCGCGTCGTGGAGCG
CGAGAAGCGCGCCGTGGGCATGGGCGCCGTGTTCCTGGGCTTCCTGGGCGCTGCGGGCTCCACCATGGGTGCCGCGTCC
ATCACCCTGACCGTGCAGGCCCGCCAGCTGCTCTCCGGCATCGTGCAGCAGCAGTCCAACCTCCTGAAGGCCATCGGGG
CCCAGCAGCACATGCTGAAGCTGACCGTGTGGGGCATCAAGCAGCTGCAGGCCAGGGTGCTCGCGCTCGAGCGCTACCT
GAAGGACCAGCAGCTGCTCGGCATGTGGGGCTGCTCCGGCAAGCTGATCTGCACCACCAACGTGTACTGGAACTCGTCC
TGGTCCAACAAGACCTACGGCGACATCTGGGACAACATGACCTGGATGCAGTGGGAGCGCGAGATCTCCAACTACACCG
AGATGATCTACGAGCTCCTCGAGGAGTCCCAGAACCAGCAGGAGAAGAACGAGCAGGATCTGCTCGCGCTGGACCGCTG
GAACTCCCTGTGGAACTGGTTCAACATCACCAACTGGCTGTGGTACATCAAGATCTTCATCATGATCGTGGGCGGCCTG
ATCGGCCTGCGCATCATCTTCGCCGTGCTGTCGCTGGTGAACCGCGTGCGCCAGGGCTGATGAGaattcggtgaccggg
acctggatcc

Figure 2A cont.

>HV1300656, CH505.M5gp145 (SEQ ID NO. 88)

MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKLTPLCVTLNCTNATASNSSIIEGMKNCSFNITTELRDKREK
KNALFYKLDIVQLDGNSSQYRLINCNTSVITQACPKVSFDPIPIHYCAPAGYAILKCNNKTFTGTGPCNNVSTVQCTHG
IKPVVSTQLLLNGSLAEGEIIIRSENITKNVKTIIVHLNESVKIECTRPNNKTRTSIRIGPGQAFYATGQVIGDIREAY
CNINESKWNETLQRVSKKLKEYFPHKNITFQPSSGGDLEITTHSFNCGGEFFYCNTSSLFNRTYMANSTDMANSTETNS
TRTITIHCRIKQIINMWQEVGRAMYAPPIAGNITCISNITGLLLTRDGGKNNTETFRPGGGNMKDNWRSELYKYKVVEV
KPLGVAPTNARRRVVEREKRAVGMGAVFLGFLGAAGSTMGAASITLTVQARQLLSGIVQQQSNLLKAIEAQQHMLKLTV
WGIKQLQARVLALERYLKDQQLLGMWGCSGKLICTTNVYWNSSWSNKTYGDIWDNMTWMQWEREISNYTEIIYELLEES
QNQQEKNEQDLLALDRWNSLWNWFNITNWLWYIKIFIMIVGGLIGLRIIFAVLSLVNRVRQG*

>HV1300662, CH505.M11gp145 (SEQ ID NO. 89)

MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKLTPLCVTLNCTNATASNSSIIEGMKNCSFNITTELRDKREK
KNALFYKLDIVQLDGNSSQYRLINCNTSVITQACPKVSFDPIPIHYCAPAGYAILKCNNKTFTGTGPCNNVSTVQCTHG
IKPVVSTQLLLNGSLAEGEIIIRSENITDNGKTIIVHLNESVKIECTRPNNKTRTSIRIGPGQAFYATGQVIGDIREAY
CNINESKWNETLQRVSKKLKEYFPHKNITFQPSSGGDLEITTHSFNCGGEFFYCNTSSLFNRTYMANSTDMANSTETNS
TRTITIHCRIKQIINMWQEVGRAMYAPPIAGNITCISNITGLLLTRDGGKNNTETFRPGGGNMKDNWRSELYKYKVVEV
KPLGVAPTNARRRVVEREKRAVGMGAVFLGFLGAAGSTMGAASITLTVQARQLLSGIVQQQSNLLKAIEAQQHMLKLTV
WGIKQLQARVLALERYLKDQQLLGMWGCSGKLICTTNVYWNSSWSNKTYGDIWDNMTWMQWEREISNYTEIIYELLEES
QNQQEKNEQDLLALDRWNSLWNWFNITNWLWYIKIFIMIVGGLIGLRIIFAVLSLVNRVRQG*

>HV1300635, CH505w020.14gp145 (SEQ ID NO. 90)

MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKLTPLCVTLNCTNATASNNSIIEGMKNCSFNITTELRDKREK
KNALFYKLDIVQLDGNSSQYRLINCNTSVITQACPKVSFDPIPIHYCAPAGYAILKCNNKTFTGTGPCNNVSTVQCTHG
IKPVVSTQLLLNGSLAEGEIIIRSENITNNAKTIIVHLNESVKIECTRPNNKTRTSIRIGPGQAFYATGQVIGDIRKAY
CNISESKWNETLQRVSKKLKEYFPHKNITFQPSSGGDLEITTHSFNCGGEFFYCNTSSLFNRTYMANSTDMANSTETNS
TRTITLHCRIKQIINMWQEVGRAMYAPPIAGNITCISNITGLLLTRDGGKNNTETFRPGGGNMKDNWRSELYKYKVVEV
KPLGVAPTNARRRVVEREKRAVGMGAVFLGFLGAAGSTMGAASITLTVQARQLLSGIVQQQSNLLKAIEAQQHMLKLTV
WGIKQLQARVLALERYLKDQQLLGMWGCSGKLICTTNVYWNSSWSNKTYGDIWDNMTWMQWEREISNYTEIIYELLEES
QNQQEKNEQDLLALDRWNSLWNWFNITNWLWYIKIFIMIVGGLIGLRIIFAVLSLVNRVRQG*

Figure 2A cont.

>HV1300636, CH505w030.28gp145 (SEQ ID NO. 91)

MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKMTPLCVTLNCTNATAINSSIIEGMKNCSFNITTELRDKREK
KNALFYKLDIVQLDGNSSQYRLINCNTSVITQACPKVSFDPIPIHYCAPAGYAILKCNNKTFTGTGPCNNVSTVQCTHG
IKPVVSTQLLLNGSLAEGEIIIRSENITNNDKTIIVHLNESVKIECTRPNNKTRTSIRIGPGQAFYATGQVIGDIREAH
CNISESKWNETLQRVSKKLKEYFPHKNITFQPSSGGDLEITTHSFNCGGEFFYCNTSSLFNRTYMANSTDMANSTETNS
TRTITIRCRIKQIINMWQEVGRAMYAPPIAGNITCISNITGLLLTRDGGKNNTETFRPGGGNMKDNWRSELYKYKVVEV
KPLGVAPTNARRRVVEREKRAVGMGAVFLGFLGAAGSTMGAASITLTVQARQLLSGIVQQQSNLLKAIEAQQHMLKLTV
WGIKQLQARVLALERYLKDQQLLGMWGCSGKLICTTNVYWNSSWSNKSYGDIWDNMTWMQWEREISNYTEIIYELLEES
QNQQEKNEQDLLALDRWNSLWNWFNITNWLWYIKIFIMIVGGLIGLRIIFAVLSLVNRVRQG*

>HV1300638, CH505w053.31gp145 (SEQ ID NO. 92)

MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKLTPLCVTLNCTDATASNATASNATASNSSIIEGMKNCSFNI
TTELRDKREKKNALFYKLDIVQLDGNSSQYRLINCNTSVITQACPKVSFDPIPIHYCAPAGYAILKCNNKTFNGTGPCN
NVSTVQCTHGIKPVVSTQLLLNGSLAEGEIIIRSENITDNGKTIIVHLNESVKIECTRPSNNTRTSIRIGPGQAFYATG
QVIGDIREAHCNISESKWNETLQRVSKKLKEYFPHKNITFQPSSGGDLEITTHSFNCGGEFFYCNTSSLFNRTYMANST
ETNSTRIITIRCRIKQIINMWQEVGRAMYAPPIAGNITCISNITGLLLTRDGGNNNTETFRPGGGNMKDNWRSELYKYK
VVEVKPLGVAPTNARRRVVEREKRAVGMGAVFLGFLGAAGSTMGAASITLTVQARQLLSGIVQQQSNLLKAIGAQQHML
KLTVWGIKQLQARVLALERYLKDQQLLGMWGCSGKLICTTNVYWNSSWSNKTYGDIWDNMTWMQWEREISNYTEMIYEL
LEESQNQQEKNEQDLLALDRWNSLWNWFNITNWLWYIKIFIMIVGGLIGLRIIFAVLSLVNRVRQG*

>HV1300696, CH505w53.16gp145 (SEQ ID NO. 93)

MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKLTPLCVTLNCTNANATASNSSIIEGMNSSIIEGMKNCSFNI
TTELRDKREKKNALFYKLDIVQLDGNSSQYRLINCNTSVITQACPKVSFDPIPIHYCAPAGYAILKCNNKTFNGTGPCN
NVSTVQCTHGIKPVVSTQLLLNGSLAEGEIIIRSENITDNGKTIIVHLNESVKIECTRPSNNTRTSIRIGPGQAFYATG
QVIGDIREAHCNISESKWNETLQRVSEKLKEYFPHKNITFQPSSGGDLEITTHSFNCGGEFFYCNTSSLFNRTYMATST
DMANSTETNSTRIITIRCRIKQIINMWQEVGRAMYAPPIAGNITCISNITGLLLTRDGGKNNTETFETFRPGGGNMKDN
WRSELYKYKVVEVKPLGVAPTNARRRVVEREKRAVGMGAVFLGFLGAAGSTMGAASITLTVQARQLLSGIVQQQSNLLK
AIEAQQHMLKLTVWGIKQLQARVLALERYLKDQQLLGMWGCSGKLICTTNVYWNSSWSNKTYGDIWDNMTWMQWEREIS
NYTEIIYELLEESQNQQEKNEQDLLALDRWNSLWNWFNITNWLWYIKIFIMIVGGLIGLRIIFAVLSLVNRVRQG*

Figure 2A cont.

>HV1300689, CH505w30.21gp145 (SEQ ID NO. 94)

MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKLTPLCVTLNCTNATTNATASNSSIIEEMKNCSFNITTELRD
KREKKNALFYKLDIVQLDGNSSQYRLINCNTSVITQACPKVSFDPIPIHYCAPAGYAILKCNNKTFTGTGPCNNVSTVQ
CTHGIKPVVSTQLLLNGSLAEGEIIIRSENITNTAKTIIVHLNESVKIECTRPNNKTRTSIRIGPGQAFYATGQVIGDI
REAYCNISESKWNETLQRVSKKLKEYFPHKNITFQPSSGGDLEITTHSFNCGGEFFYCNTSSLFNRTYMANSTDMANST
ETNSTRTITIRCRIKQIINMWQEVGRAMYAPPIAGNITCISNITGLLLTRDGGENNTETFRPGGGNMKDNWRSELYKYK
VVEVKPLGVAPTNARRRVVEREKRAVGMGAVFLGFLGAAGSTMGAASITLTVQARQLLSGIVQQQSNLLKAIEAQQHML
KLTVWGIKQLQARVLALERYLKDQQLLGMWGCSGKLICTTNVYWNSSWSNKTYGDIWDNMTWMQWEREISNYTEIIYEL
LEESQNQQEKNEQDLLALDRWNSLWNWFNITNWLWYIKIFIMIVGGLIGLRIIFAVLSLVNRVRQG*

>HV1300705, CH505w78.33gp145 (SEQ ID NO. 95)

MRVTGIQRNYPQWWIWSMLGLWMLMICNGMWVTVYYGVPVWKEAKTTLFCASDAKAYEKEVHNVWATHACVPTDPNPQE
MVLKNVTENFNMWKNDMADQMHEDVISLWDQSLKPCVKLTPLCVTLNCIDANATASNATASNSSIIEGMKNCSFNITTE
LRDKIEKKNALFYKLDIVQLDGNSSQYRLINCNTSVITQACPKVSFDPIPIHYCAPAGYAILKCNNKTFNGTGPCNNVS
TVQCTHGIKPVVSTQLLLNGSLAEGEIIIRSENITNSAKTIIVHLNESVKIECTRPSNNTRTSIRIGPGQAFYATGQVI
GDIRKAHCNISESKWNETLQRVSKKLKEYFPHKNITFQPSSGGDLEITTHSFNCGGEFFYCNTSSLFNRTYMANSTETN
STRTITLHCRIKQIINMWQEVGRAMYAPPIAGNITCISNITGLLLTRDGGNNNTTETFRPGGGNMKDNWRSELYKYKVV
EIKPLGVAPTNARRRVVEREKRAVGMGAVFLGFLGAAGSTMGAASITLTVQARQLLSGIVQQQSNLLKAIEAQQHMLKL
TVWGIKQLQARVLALERYLKDQQLLGMWGCSGKLICTTNVYWNSSWSNKTYGDIWDNMTWMQWEREISDYTEIIYELLE
ESQNQQEKNEQDLLALDRWNSLWNWFNITNWLWYIKIFIMIVGGLIGLRIIFAVLSLVNRVRQG*

>HV1300714, CH505w100.B6gp145 (SEQ ID NO. 96)

MKVRGIQRNYPQWWIWSMLGLWMLMICNGMWVTVYYGVPVWKEAKTTLFCASDAKAYEKEVHNVWATHACVPTDPNPQE
MVLENVTENFNMWKNDMADQMHEDVISLWDQSLKPCVKLTPLCVTLNCTDANATASNTNATASNINATASKSSIIEEMK
NCSFNITTELRDKREKKYALFYKLDIVQLDGNSSQYRLINCNTSVITQACPKVSFDPIPIHYCAPAGYAILKCNNKTFN
GTGPCNNVSTVQCTHGIKPVVSTQLLLNGSLAEGEIIIRSENITDNSKTIIVHLNESVKIECTRPSNNTRTSIRIGPGQ
AFYATGQVIGDIREAHCNISESKWNETLQRVSKKLKEYFPDKNITFQPSSGGDPEITTHSFNCGGEFFYCNTSSLFNRT
YMANSTETNSTRTITLHCRIKQIINMWQEVGRAMYAPPIAGNITCISNITGLLLTRDGGENTRDGGNNNTETFRPEGGN
MKDNWRSELYKYKVVEVKPLGVAPTKARRRVVEREKRAVGMGAVFLGFLGAAGSTMGAASITLTVQARQLLSGIVQQQS
NLLKAIEAQQHMLKLTVWGIKQLQARVLALERYLKDQQLLGMWGCSGKLICTTNVYWNSSWSNKTYGDIWDNMTWMQWE
REISNYTDIIYDLLEESQNQQEKNEQDLLALDRWNSLWNWFNITKWLWYIKIFIMIVGGLIGLRIIFAVLSLVNRVRQG
*

Figure 2A cont.

>HV1300639, CH505w078.15gp145 (SEQ ID NO. 97)

MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKLTPLCVTLSCTNATNATASNSSILEGMKNCSFNITTELRDK
REKKNALFYKLDIVQLDGNSSQYRLINCNTSVITQACPKVSFDPIPIHYCAPAGYAILKCNNKTFNGTGPCNNVSTVQC
THGIKPVVSTQLLLNGSLAEGEIIIRSKNITDNGKTIIVHLNESVKIECTRPSNNTRTSIRIGPGQAFYATGQVIGDIR
EAHCNISESKWNETLQRVSEKLKEYFPHKNITFQPSSGGDLEITTHSFNCGGEFFYCNTSSLFNRTYMATSTDMANSTE
TNSTRIITIRCRIKQIINMWQEVGRAMYAPPIAGNITCISNITGLLLTRDGGKNDTDTFRPEGGNMKDNWRSELYKYKV
VEVKPLGVAPTNARRRVVEREKRAVGMGAVFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNKTYGDIWDNMTWMQWEREISNYTELIYELL
EESQNQQEKNEQDLLALDRWNSLWNWFNITNWLWYIKIFIMIVGGLIGLRIIFAVLSLVNRVRQG*

>HV1300638, CH505w053.31gp145 (SEQ ID NO. 98)

MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKLTPLCVTLNCTDATASNATASNATASNSSIIEGMKNCSFNI
TTELRDKREKKNALFYKLDIVQLDGNSSQYRLINCNTSVITQACPKVSFDPIPIHYCAPAGYAILKCNNKTFNGTGPCN
NVSTVQCTHGIKPVVSTQLLLNGSLAEGEIIIRSENITDNGKTIIVHLNESVKIECTRPSNNTRTSIRIGPGQAFYATG
QVIGDIREAHCNISESKWNETLQRVSKKLKEYFPHKNITFQPSSGGDLEITTHSFNCGGEFFYCNTSSLFNRTYMANST
ETNSTRIITIRCRIKQIINMWQEVGRAMYAPPIAGNITCISNITGLLLTRDGGNNNTETFRPGGGNMKDNWRSELYKYK
VVEVKPLGVAPTNARRRVVEREKRAVGMGAVFLGFLGAAGSTMGAASITLTVQARQLLSGIVQQQSNLLKAIGAQQHML
KLTVWGIKQLQARVLALERYLKDQQLLGMWGCSGKLICTTNVYWNSSWSNKTYGDIWDNMTWMQWEREISNYTEMIYEL
LEESQNQQEKNEQDLLALDRWNSLWNWFNITNWLWYIKIFIMIVGGLIGLRIIFAVLSLVNRVRQG*

Figure 2A cont.

| **Env name** | **Plasmid ID** | Bar code |
|---|---|---|
| CH505.M5D8gp120 | HV1300531_v2 | **TAGTAAG**gtgaccgaattcgggacccggatcc (SEQ ID NO. 99) |
| CH505.M11D8gp120 | HV1300537_v2 | **TAGTAAG**gtgaccgaattcaggtcccggatcc (SEQ ID NO. 100) |
| CH505w020.14D8gp120 | HV1300556_v2 | **TAGTAAG**ggacccgaattcggtcaccggatcc (SEQ ID NO. 101) |
| CH505w030.28D8gp120 | HV1300578_v2 | **TAGTAAG**ggtcctgaattcggttaccggatcc (SEQ ID NO. 102) |
| CH505w078.15D8gp120 | HV1300592 | **TAGTAAG**aattcggtcaccgggtcctggatcc (SEQ ID NO. 103) |
| CH505w053.16D8gp120 | HV1300583 | **TAGTAAG**aattcggtgaccgggtcccggatcc (SEQ ID NO. 104) |

CH505 Env gp120 gene constructs were cloned into VRC8400 at the unique SalI and BamHI sites.

Figure 2B

>HV1300531_v2, CH505.M5D8gp120 (SEQ ID NO. 105)
gtcgacaagaagccaccATGCGCGTGATGGGCATCCAGCGCAACTACCCGCAGTGGTGGATCTGGTCGATGCTGGGCTT
CTGGATGCTCATGATCTGCAACGGCGTGCCGGTGTGGAAGGAGGCCAAGACGACCCTGTTCTGCGCGTCGGACGCCAAG
GCCTACGAGAAGGAGGTGCACAACGTGTGGGCGACCCACGCCTGCGTGCCCACGGACCCCAACCCGCAGGAGATGGTGC
TGAAGAACGTGACCGAGAACTTCAACATGTGGAAGAACGACATGGTGGACCAGATGCACGAGGACGTGATCTCCCTGTG
GGACCAGTCCCTGAAGCCCTGCGTGAAGCTGACCCCGCTGTGCGTGACCCTGAACTGCACCAACGCCACCGCGTCCAAC
TCCTCCATCATCGAGGGCATGAAGAACTGCTCCTTCAACATCACGACGGAGCTGCGCGACAAGCGCGAGAAGAAGAACG
CCCTGTTCTACAAGCTGGACATCGTGCAGCTGGACGGCAACTCCTCGCAGTACAGGCTGATCAACTGCAACACCTCCGT
CATCACGCAGGCGTGCCCCAAGGTGTCCTTCGACCCCATCCCCATCCACTACTGCGCCCCCGCCGGCTACGCCATCCTG
AAGTGCAACAACAAGACCTTCACCGGCACCGGCCCGTGCAACAACGTGTCCACCGTGCAGTGCACGCACGGGATCAAGC
CCGTGGTGTCCACGCAGCTGCTCCTGAACGGGTCGCTGGCCGAGGGCGAGATCATCATCCGGTCCGAGAACATCACGAA
GAACGTGAAGACCATCATCGTGCACCTGAACGAGTCCGTGAAGATCGAGTGCACCCGCCCGAACAACAAGACGCGCACC
TCCATCCGGATCGGCCCTGGCCAGGCCTTCTACGCCACCGGCCAGGTGATCGGCGACATCCGCGAGGCGTACTGCAACA
TCAACGAGTCCAAGTGGAACGAGACCCTGCAGCGCGTGTCCAAGAAGCTGAAGGAGTACTTCCCCCACAAGAACATCAC
CTTCCAGCCGTCGTCCGGCGGCGACCTCGAGATCACCACGCACTCCTTCAACTGCGGTGGCGAGTTCTTCTACTGCAAC
ACGTCGTCGCTGTTCAACCGCACCTACATGGCCAACTCCACCGACATGGCCAACTCCACCGAGACCAACTCCACGCGCA
CCATCACGATCCACTGCCGCATCAAGCAGATCATCAACATGTGGCAGGAGGTGGGCCGCGCCATGTACGCACCGCCCAT
CGCCGGCAACATCACCTGCATCTCCAACATCACCGGCCTCCTGCTGACCCGCGACGGCGGCAAGAACAACACGGAGACC
TTCAGGCCAGGCGGAGGCAACATGAAGGACAACTGGCGCTCCGAGCTGTACAAGTACAAGGTGGTGGAGGTGAAGCCCC
TGGGCGTGGCACCCACCAACGCCCGCGAGCGCGTCGTGGAGCGCGAGAAGGAGTAGTAAGgtgaccgaattcgggaccc
ggatcc

Figure 2B cont.

>HV1300537_v2, CH505.M11D8gp120 (SEQ ID NO. 106)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCGTGCCGGTGTGGAAGGAGGCCAAGACGACCCTGTTCTGCGCGTCGGACGCCAAG
GCCTACGAGAAGGAGGTGCACAACGTGTGGGCGACCCACGCCTGCGTGCCCACGGACCCCAACCCGCAGGAGATGGTGC
TGAAGAACGTGACCGAGAACTTCAACATGTGGAAGAACGACATGGTGGACCAGATGCACGAGGACGTGATCTCCCTGTG
GGACCAGTCCCTGAAGCCCTGCGTGAAGCTGACCCCGCTGTGCGTGACCCTGAACTGCACCAACGCCACCGCGTCCAAC
TCCTCCATCATCGAGGGCATGAAGAACTGCTCCTTCAACATCACGACGGAGCTGCGCGACAAGCGCGAGAAGAAGAACG
CCCTGTTCTACAAGCTGGACATCGTGCAGCTGGACGGCAACTCCTCGCAGTACAGGCTGATCAACTGCAACACCTCCGT
CATCACGCAGGCGTGCCCCAAGGTGTCCTTCGACCCCATCCCCATCCACTACTGCGCCCCCGCCGGCTACGCCATCCTG
AAGTGCAACAACAAGACCTTCACCGGCACCGGCCCGTGCAACAACGTGTCCACCGTGCAGTGCACGCACGGGATCAAGC
CCGTGGTGTCCACGCAGCTGCTCCTGAACGGGTCGCTGGCCGAGGGCGAGATCATCATCCGGTCCGAGAACATCACGGA
CAACGGGAAGACCATCATCGTGCACCTGAACGAGTCCGTGAAGATCGAGTGCACCCGCCCGAACAACAAGACGCGCACC
TCCATCCGGATCGGCCCTGGCCAGGCCTTCTACGCCACCGGCCAGGTGATCGGCGACATCCGCGAGGCGTACTGCAACA
TCAACGAGTCCAAGTGGAACGAGACCCTGCAGCGCGTGTCCAAGAAGCTGAAGGAGTACTTCCCCCACAAGAACATCAC
CTTCCAGCCGTCGTCCGGCGGCGACCTCGAGATCACCACGCACTCCTTCAACTGCGGTGGCGAGTTCTTCTACTGCAAC
ACGTCGTCGCTGTTCAACCGCACCTACATGGCCAACTCCACCGACATGGCCAACTCCACCGAGACCAACTCCACGCGCA
CCATCACGATCCACTGCCGCATCAAGCAGATCATCAACATGTGGCAGGAGGTGGGCCGCGCCATGTACGCACCGCCCAT
CGCCGGCAACATCACCTGCATCTCCAACATCACCGGCCTCCTGCTGACCCGCGACGGCGGCAAGAACAACACGGAGACC
TTCAGGCCAGGCGGAGGCAACATGAAGGACAACTGGCGCTCCGAGCTGTACAAGTACAAGGTGGTGGAGGTGAAGCCCC
TGGGCGTGGCACCCACCAACGCCCGCGAGCGCGTCGTGGAGCGCGAGAAGGAGTAGTAAGgtgaccgaattcaggtccc
ggatcc

Figure 2B cont.

>HV1300556_v2, CH505w020.14D8gp120 (SEQ ID NO. 107)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCGTGCCGGTGTGGAAGGAGGCCAAGACGACCCTGTTCTGCGCGTCGGACGCCAAG
GCCTACGAGAAGGAGGTGCACAACGTGTGGGCGACCCACGCCTGCGTGCCCACGGACCCCAACCCGCAGGAGATGGTGC
TGAAGAACGTGACCGAGAACTTCAACATGTGGAAGAACGACATGGTGGACCAGATGCACGAGGACGTGATCTCCCTGTG
GGACCAGTCCCTGAAGCCCTGCGTGAAGCTGACCCCGCTGTGCGTGACCCTGAACTGCACCAACGCCACCGCGTCCAAC
AACTCCATCATCGAGGGCATGAAGAACTGCTCCTTCAACATCACGACGGAGCTGCGCGACAAGCGCGAGAAGAAGAACG
CCCTGTTCTACAAGCTGGACATCGTGCAGCTGGACGGCAACTCCTCGCAGTACAGGCTGATCAACTGCAACACCTCCGT
CATCACGCAGGCGTGCCCCAAGGTGTCCTTCGACCCCATCCCCATCCACTACTGCGCCCCCGCCGGCTACGCCATCCTG
AAGTGCAACAACAAGACCTTCACCGGCACCGGCCCGTGCAACAACGTGTCCACCGTGCAGTGCACGCACGGGATCAAGC
CCGTGGTGTCCACGCAGCTGCTCCTGAACGGGTCGCTGGCCGAGGGCGAGATCATCATCCGGTCCGAGAACATCACGAA
CAACGCGAAGACCATCATCGTGCACCTGAACGAGTCCGTGAAGATCGAGTGCACCCGCCCGAACAACAAGACGCGCACG
TCCATCCGGATCGGCCCTGGCCAGGCCTTCTACGCCACCGGCCAGGTGATCGGCGACATCCGCAAGGCGTACTGCAACA
TCTCGGAGTCCAAGTGGAACGAGACCCTGCAGCGCGTGTCCAAGAAGCTGAAGGAGTACTTCCCCCACAAGAACATCAC
CTTCCAGCCGTCGTCCGGCGGCGACCTCGAGATCACCACGCACTCCTTCAACTGCGGTGGCGAGTTCTTCTACTGCAAC
ACGTCGTCGCTGTTCAACCGCACCTACATGGCCAACTCCACCGACATGGCCAACTCCACCGAGACCAACTCCACGCGCA
CCATCACGCTCCACTGCCGCATCAAGCAGATCATCAACATGTGGCAGGAGGTGGGCCGCGCCATGTACGCACCGCCCAT
CGCCGGCAACATCACCTGCATCTCCAACATCACCGGCCTCCTGCTGACCCGCGACGGCGGCAAGAACAACACGGAGACC
TTCAGGCCAGGCGGAGGCAACATGAAGGACAACTGGCGCTCCGAGCTGTACAAGTACAAGGTGGTGGAGGTGAAGCCCC
TGGGCGTGGCACCCACCAACGCCCGCGAGCGCGTCGTGGAGCGCGAGAAGGAGTAGTAAGggacccgaattcggtcacc
ggatcc

Figure 2B cont.

>HV1300578_v2, CH505w030.28D8gp120 (SEQ ID NO. 108)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCGTGCCGGTGTGGAAGGAGGCCAAGACGACCCTGTTCTGCGCGTCGGACGCCAAG
GCCTACGAGAAGGAGGTGCACAACGTGTGGGCGACCCACGCCTGCGTGCCCACGGACCCCAACCCGCAGGAGATGGTGC
TGAAGAACGTGACCGAGAACTTCAACATGTGGAAGAACGACATGGTGGACCAGATGCACGAGGACGTGATCTCCCTGTG
GGACCAGTCCCTGAAGCCCTGCGTGAAGATGACCCCGCTGTGCGTGACCCTGAACTGCACCAACGCCACCGCGATCAAC
TCCTCCATCATCGAGGGCATGAAGAACTGCTCCTTCAACATCACGACGGAGCTGCGCGACAAGCGCGAGAAGAAGAACG
CCCTGTTCTACAAGCTGGACATCGTGCAGCTGGACGGCAACTCCTCGCAGTACAGGCTGATCAACTGCAACACCTCCGT
CATCACGCAGGCGTGCCCCAAGGTGTCCTTCGACCCCATCCCCATCCACTACTGCGCCCCCGCCGGCTACGCCATCCTG
AAGTGCAACAACAAGACCTTCACCGGCACCGGCCCGTGCAACAACGTGTCCACCGTGCAGTGCACGCACGGGATCAAGC
CCGTGGTGTCCACGCAGCTGCTCCTGAACGGGTCGCTGGCCGAGGGCGAGATCATCATCCGGTCCGAGAACATCACGAA
CAACGACAAGACCATCATCGTGCACCTGAACGAGTCCGTGAAGATCGAGTGCACCCGCCCGAACAACAAGACGCGCACC
TCCATCCGGATCGGCCCTGGCCAGGCCTTCTACGCCACCGGCCAGGTGATCGGCGACATCCGCGAGGCGCACTGCAACA
TCTCGGAGTCCAAGTGGAACGAGACCCTGCAGCGCGTGTCCAAGAAGCTGAAGGAGTACTTCCCCCACAAGAACATCAC
CTTCCAGCCGTCGTCCGGCGGCGACCTCGAGATCACCACGCACTCCTTCAACTGCGGTGGCGAGTTCTTCTACTGCAAC
ACGTCGTCGCTGTTCAACCGCACCTACATGGCCAACTCCACCGACATGGCCAACTCCACCGAGACCAACTCCACGCGCA
CCATCACGATCCGCTGCCGCATCAAGCAGATCATCAACATGTGGCAGGAGGTGGGCCGCGCCATGTACGCACCGCCCAT
CGCCGGCAACATCACCTGCATCTCCAACATCACCGGCCTCCTGCTGACCCGCGACGGCGGCAAGAACAACACGGAGACC
TTCAGGCCAGGCGGAGGCAACATGAAGGACAACTGGCGCTCCGAGCTGTACAAGTACAAGGTGGTGGAGGTGAAGCCCC
TGGGCGTGGCACCCACCAACGCCCGCGAGCGCGTCGTGGAGCGCGAGAAGGAGTAGTAAGggtcctgaattcggttacc
ggatcc

Figure 2B cont.

>HV1300592, CH505w078.15D8gp120 (SEQ ID NO. 109)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCGTGCCGGTGTGGAAGGAGGCCAAGACGACCCTGTTCTGCGCGTCGGACGCCAAG
GCCTACGAGAAGGAGGTGCACAACGTGTGGGCGACCCACGCCTGCGTGCCCACGGACCCCAACCCGCAGGAGATGGTGC
TGAAGAACGTGACCGAGAACTTCAACATGTGGAAGAACGACATGGTGGACCAGATGCACGAGGACGTGATCTCCCTGTG
GGACCAGTCCCTGAAGCCCTGCGTGAAGCTGACCCCGCTGTGCGTGACCCTGAGCTGCACGAACGCCACCAACGCGACG
GCGTCGAACTCGTCCATCCTCGAGGGGATGAAGAACTGCTCCTTCAACATCACGACGGAGCTGCGCGACAAGCGCGAGA
AGAAGAACGCCCTGTTCTACAAGCTGGACATCGTGCAGCTGGACGGCAACTCCTCGCAGTACAGGCTGATCAACTGCAA
CACCTCCGTCATCACGCAGGCGTGCCCCAAGGTGTCCTTCGACCCCATCCCCATCCACTACTGCGCCCCCGCCGGCTAC
GCCATCCTGAAGTGCAACAACAAGACCTTCAACGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCGAAGAA
CATCACGGACAACGGGAAGACCATCATCGTGCACCTGAACGAGTCCGTGAAGATCGAGTGCACCCGCCCGAGCAACAAC
ACGCGCACCTCCATCCGGATCGGCCCTGGCCAGGCCTTCTACGCCACCGGCCAGGTGATCGGCGACATCCGCGAGGCGC
ACTGCAACATCTCCGAGTCCAAGTGGAACGAGACCCTGCAGCGCGTGTCCGAGAAGCTGAAGGAGTACTTCCCCCACAA
GAACATCACCTTCCAGCCGTCGTCCGGCGGCGACCTCGAGATCACCACGCACTCCTTCAACTGCGGTGGCGAGTTCTTC
TACTGCAACACGTCGTCGCTGTTCAACCGCACCTACATGGCCACCTCCACCGACATGGCCAACTCCACCGAGACCAACT
CCACGCGCATCATCACGATCCGCTGCCGCATCAAGCAGATCATCAACATGTGGCAGGAGGTGGGCCGCGCCATGTACGC
ACCGCCCATCGCCGGCAACATCACCTGCATCTCCAACATCACCGGCCTCCTGCTGACCCGCGACGGCGGCAAGAACGAC
ACGGACACCTTCAGGCCAGAGGGAGGCAACATGAAGGACAACTGGCGCTCCGAGCTGTACAAGTACAAGGTGGTGGAGG
TGAAGCCCCTGGGCGTGGCACCCACCAACGCCCGCGAGCGCGTCGTGGAGCGCGAGAAGGAGTAGTAAGaattcggtca
ccgggtcctggatcc

Figure 2B cont.

>HV1300583, CH505w053.16D8gp120 (SEQ ID NO. 110)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCGTGCCGGTGTGGAAGGAGGCCAAGACGACCCTGTTCTGCGCGTCGGACGCCAAG
GCCTACGAGAAGGAGGTGCACAACGTGTGGGCGACCCACGCCTGCGTGCCCACGGACCCCAACCCGCAGGAGATGGTGC
TGAAGAACGTGACCGAGAACTTCAACATGTGGAAGAACGACATGGTGGACCAGATGCACGAGGACGTGATCTCCCTGTG
GGACCAGTCCCTGAAGCCCTGCGTGAAGCTGACCCCGCTGTGCGTGACCCTGAACTGCACCAACGCGAACGCCACCGCG
TCCAACTCCTCTATCATCGAGGGGATGAACTCCTCCATCATCGAGGGCATGAAGAACTGCTCCTTCAACATCACGACGG
AGCTGCGCGACAAGCGCGAGAAGAAGAACGCCCTGTTCTACAAGCTGGACATCGTGCAGCTGGACGGCAACTCCTCGCA
GTACAGGCTGATCAACTGCAACACCTCCGTCATCACGCAGGCGTGCCCCAAGGTGTCCTTCGACCCCATCCCCATCCAC
TACTGCGCCCCCGCCGGCTACGCCATCCTGAAGTGCAACAACAAGACCTTCAACGGCACCGGCCCGTGCAACAACGTGT
CCACCGTGCAGTGCACGCACGGGATCAAGCCCGTGGTGTCCACGCAGCTGCTCCTGAACGGGTCGCTGGCCGAGGGCGA
GATCATCATCCGGTCCGAGAACATCACGGACAACGGGAAGACCATCATCGTGCACCTGAACGAGTCCGTGAAGATCGAG
TGCACCCGCCCGAGCAACAACACGCGCACCTCCATCCGGATCGGCCCTGGCCAGGCCTTCTACGCCACCGGCCAGGTGA
TCGGCGACATCCGCGAGGCGCACTGCAACATCTCGGAGTCCAAGTGGAACGAGACCCTGCAGCGCGTGTCCGAGAAGCT
GAAGGAGTACTTCCCCCACAAGAACATCACCTTCCAGCCGTCGTCCGGCGGCGACCTCGAGATCACCACGCACTCCTTC
AACTGCGGTGGCGAGTTCTTCTACTGCAACACGTCGTCGCTGTTCAACCGCACCTACATGGCCACGTCCACCGACATGG
CCAACTCCACCGAGACCAACTCCACGCGCATCATCACGATCCGGTGCCGCATCAAGCAGATCATCAACATGTGGCAGGA
GGTGGGCCGCGCCATGTACGCACCGCCCATCGCCGGCAACATCACCTGCATCTCCAACATCACCGGCCTCCTGCTGACC
CGCGACGGCGGCAAGAACAACACGGAGACCTTCGAGACGTTCAGGCCAGGCGGAGGCAACATGAAGGACAACTGGCGCT
CCGAGCTGTACAAGTACAAGGTGGTGGAGGTGAAGCCCCTGGGCGTGGCACCCACCAACGCCCGCGAGCGCGTCGTGGA
GCGCGAGAAGGAGTAGTAAGaattcggtgaccgggtcccggatcc

Figure 2B cont.

>HV1300574_v2, CH505w030.21D8gp120 (SEQ ID NO. 111)

gtgtcgacaagaagccaccATGCGCGTGATGGGCATCCAGCGCAACTACCCGCAGTGGTGGATCTGGTCGATGCTGGGC
TTCTGGATGCTCATGATCTGCAACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGT
GCTGAAGAACGTGACCGAGAACTTCAACATGTGGAAGAACGACATGGTGGACCAGATGCACGAGGACGTGATCTCCCTG
TGGGACCAGTCCCTGAAGCCCTGCGTGAAGCTGACCCCGCTGTGCGTGACCCTGAACTGCACCAACGCGACGACGAACG
CCACCGCGTCCAACTCGTCCATCATCGAGGAGATGAAGAACTGCTCCTTCAACATCACGACGGAGCTGCGCGACAAGCG
CGAGAAGAAGAACGCCCTGTTCTACAAGCTGGACATCGTGCAGCTGGACGGCAACTCCTCGCAGTACAGGCTGATCAAC
TGCAACACCTCCGTCATCACGCAGGCGTGCCCCAAGGTGTCCTTCGACCCCATCCCCATCCACTACTGCGCCCCCGCCG
GCTACGCCATCCTGAAGTGCAACAACAAGACCTTCACCGGCACCGGCCCGTGCAACAACGTGTCCACCGTGCAGTGCAC
GCACGGGATCAAGCCCGTGGTGTCCACGCAGCTGCTCCTGAACGGGTCGCTGGCCGAGGGCGAGATCATCATCCGGTCC
GAGAACATCACGAACACGGCGAAGACCATCATCGTGCACCTGAACGAGTCCGTGAAGATCGAGTGCACCCGCCCGAACA
ACAAGACGCGCACCTCCATCCGGATCGGCCCTGGCCAGGCCTTCTACGCCACCGGCCAGGTGATCGGCGACATCCGCGA
GGCGTACTGCAACATCTCGGAGTCCAAGTGGAACGAGACCCTGCAGCGCGTGTCCAAGAAGCTGAAGGAGTACTTCCCC
CACAAGAACATCACCTTCCAGCCGTCGTCCGGCGGCGACCTCGAGATCACCACGCACTCCTTCAACTGCGGTGGCGAGT
TCTTCTACTGCAACACGTCGTCGCTGTTCAACCGCACCTACATGGCCAACTCCACCGACATGGCCAACTCCACCGAGAC
CAACTCCACGCGCACCATCACGATCCGGTGCCGCATCAAGCAGATCATCAACATGTGGCAGGAGGTGGGCCGCGCCATG
TACGCACCGCCCATCGCCGGCAACATCACCTGCATCTCCAACATCACCGGCCTCCTGCTGACCCGCGACGGCGGCGAGA
ACAACACGGAGACCTTCAGGCCAGGCGGAGGCAACATGAAGGACAACTGGCGCTCCGAGCTGTACAAGTACAAGGTGGT
GGAGGTGAAGCCCCTGGGCGTGGCACCCACCAACGCCCGCGAGCGCGTCGTGGAGCGCGAGAAGGAGTAGTAAGggtcc
cgaattcggttaccggatcc

Figure 2B cont.

>HV1300595, CH505w078.33D8gp120 (SEQ ID NO. 112)

gtcgacaagaagccaccATGCGCGTGACGGGCATCCAGCGCAACTACCCGCAGTGGTGGATCTGGTCGATGCTGGGCCT
CTGGATGCTCATGATCTGCAACGGCGTGCCGGTGTGGAAGGAGGCCAAGACGACCCTGTTCTGCGCGTCGGACGCCAAG
GCCTACGAGAAGGAGGTGCACAACGTGTGGGCGACCCACGCCTGCGTGCCCACGGACCCCAACCCGCAGGAGATGGTGC
TGAAGAACGTGACCGAGAACTTCAACATGTGGAAGAACGACATGGCGGACCAGATGCACGAGGACGTGATCTCCCTGTG
GGACCAGTCCCTGAAGCCCTGCGTGAAGCTGACCCCGCTGTGCGTGACCCTGAACTGCATCGACGCCAACGCGACCGCG
TCCAACGCGACGGCATCCAACTCGTCCATCATCGAGGGGATGAAGAACTGCTCCTTCAACATCACGACGGAGCTGCGCG
ACAAGATCGAGAAGAAGAACGCCCTGTTCTACAAGCTGGACATCGTGCAGCTGGACGGCAACTCCTCGCAGTACAGGCT
GATCAACTGCAACACCTCCGTCATCACGCAGGCGTGCCCCAAGGTGTCCTTCGACCCCATCCCCATCCACTACTGCGCC
CCCGCCGGCTACGCCATCCTGAAGTGCAACAACAAGACCTTCAACGGCACCGGCCCGTGCAACAACGTGTCCACCGTGC
AGTGCACGCACGGGATCAAGCCCGTGGTGTCCACGCAGCTGCTCCTGAACGGGTCGCTGGCCGAGGGCGAGATCATCAT
CCGGTCGGAGAACATCACGAACAGCGCGAAGACCATCATCGTGCACCTGAACGAGTCCGTGAAGATCGAGTGCACCCGC
CCGAGCAACAACACGCGCACCTCCATCCGGATCGGCCCTGGCCAGGCCTTCTACGCCACCGGCCAGGTGATCGGCGACA
TCCGCAAGGCGCACTGCAACATCTCCGAGTCCAAGTGGAACGAGACCCTGCAGCGCGTGTCCAAGAAGCTGAAGGAGTA
CTTCCCCCACAAGAACATCACCTTCCAGCCGTCGTCCGGCGGCGACCTCGAGATCACCACGCACTCCTTCAACTGCGGT
GGCGAGTTCTTCTACTGCAACACGTCGTCGCTGTTCAACCGCACCTACATGGCCAACTCCACCGAGACCAACTCCACGC
GCACGATCACGCTCCACTGCCGCATCAAGCAGATCATCAACATGTGGCAGGAGGTGGGCCGCGCCATGTACGCACCGCC
CATCGCCGGCAACATCACCTGCATCTCCAACATCACCGGCCTCCTGCTGACCCGCGACGGCGGCAACAACAACACCACG
GAGACCTTCAGGCCAGGGGGAGGCAACATGAAGGACAACTGGCGCTCCGAGCTGTACAAGTACAAGGTGGTGGAGATCA
AGCCCCTGGGCGTGGCACCCACCAACGCCCGCGAGCGCGTCGTGGAGCGCGAGAAGGAGTAGTAAGaattcggtaacca
ggtcccggatcc

Figure 2B cont.

>HV1300605, CH505w100.B6D8gp120 (SEQ ID NO. 113)

gtcgacaagaagccaccATGAAGGTGCGGGGCATCCAGCGCAACTACCCGCAGTGGTGGATCTGGTCGATGCTGGGCCT
CTGGATGCTCATGATCTGCAACGGCGTGCCGGTGTGGAAGGAGGCCAAGACGACCCTGTTCTGCGCGTCGGACGCCAAG
GCCTACGAGAAGGAGGTGCACAACGTGTGGGCGACCCACGCCTGCGTGCCCACGGACCCCAACCCGCAGGAGATGGTGC
TGGAGAACGTGACCGAGAACTTCAACATGTGGAAGAACGACATGGCGGACCAGATGCACGAGGACGTGATCTCCCTGTG
GGACCAGTCCCTGAAGCCCTGCGTGAAGCTGACCCCGCTGTGCGTGACCCTGAACTGCACGGACGCCAACGCCACCGCG
TCGAACACCAACGCGACCGCAAGCAACATCAACGCGACGGCGTCGAAGTCCTCCATCATCGAGGAGATGAAGAACTGCT
CCTTCAACATCACGACGGAGCTGCGCGACAAGCGCGAGAAGAAGTACGCCCTGTTCTACAAGCTGGACATCGTGCAGCT
GGACGGCAACTCCTCGCAGTACAGGCTGATCAACTGCAACACCTCCGTCATCACGCAGGCGTGCCCCAAGGTGTCCTTC
GACCCCATCCCCATCCACTACTGCGCCCCCGCCGGCTACGCCATCCTGAAGTGCAACAACAAGACCTTCAACGGCACCG
GCCCGTGCAACAACGTGTCCACCGTGCAGTGCACGCACGGGATCAAGCCCGTGGTGTCCACGCAGCTGCTCCTGAACGG
GTCGCTGGCCGAGGGCGAGATCATCATCCGGTCGGAGAACATCACGGACAACAGCAAGACCATCATCGTGCACCTGAAC
GAGTCCGTGAAGATCGAGTGCACCCGCCCGAGCAACAACACGCGCACCTCCATCCGGATCGGCCCTGGCCAGGCCTTCT
ACGCCACCGGCCAAGTGATCGGCGACATCCGCGAGGCGCACTGCAACATCTCCGAGTCCAAGTGGAACGAGACCCTGCA
GCGCGTGTCCAAGAAGCTGAAGGAGTACTTCCCCGACAAGAACATCACCTTCCAGCCGTCGTCCGGCGGCGACCCCGAG
ATCACCACGCACTCCTTCAACTGCGGTGGCGAGTTCTTCTACTGCAACACGTCGTCCCTGTTCAACCGCACCTACATGG
CGAACTCCACCGAGACCAACTCCACGCGCACCATCACGCTGCACTGCCGCATCAAGCAGATCATCAACATGTGGCAGGA
GGTGGGCCGCGCCATGTACGCACCGCCCATCGCCGGCAACATCACCTGCATCTCCAACATCACCGGCCTCCTGCTGACC
CGCGACGGCGGCGAGAACACCCGGGACGGAGGCAACAACAACACGGAGACCTTCAGGCCAGAGGGAGGCAACATGAAGG
ACAACTGGCGCTCCGAGCTGTACAAGTACAAGGTGGTGGAGGTGAAGCCCCTGGGCGTGGCACCCACCAAGGCCCGCGA
GCGCGTCGTGGAGCGCGAGAAGGAGTAGTAAGgtaaccgggacccgaattcggatcc

Figure 2B cont.

>HV1300586, CH505w053.31D8gp120 (SEQ ID NO. 114)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCGTGCCGGTGTGGAAGGAGGCCAAGACGACCCTGTTCTGCGCGTCGGACGCCAAG
GCCTACGAGAAGGAGGTGCACAACGTGTGGGCGACCCACGCCTGCGTGCCCACGGACCCCAACCCGCAGGAGATGGTGC
TGAAGAACGTGACCGAGAACTTCAACATGTGGAAGAACGACATGGTGGACCAGATGCACGAGGACGTGATCTCCCTGTG
GGACCAGTCCCTGAAGCCCTGCGTGAAGCTGACCCCGCTGTGCGTGACCCTGAACTGCACCGACGCCACCGCGTCCAAC
GCAACCGCGAGCAACGCCACGGCGTCGAACTCCTCCATCATCGAGGGCATGAAGAACTGCTCCTTCAACATCACGACGG
AGCTGCGCGACAAGCGCGAGAAGAAGAACGCCCTGTTCTACAAGCTGGACATCGTGCAGCTGGACGGCAACTCCTCGCA
GTACAGGCTGATCAACTGCAACACCTCCGTCATCACGCAGGCGTGCCCCAAGGTGTCCTTCGACCCCATCCCCATCCAC
TACTGCGCCCCCGCCGGCTACGCCATCCTGAAGTGCAACAACAAGACCTTCAACGGCACCGGCCCGTGCAACAACGTGT
CCACCGTGCAGTGCACGCACGGGATCAAGCCCGTGGTGTCCACGCAGCTGCTCCTGAACGGGTCGCTGGCCGAGGGCGA
GATCATCATCCGGTCCGAGAACATCACGGACAACGGGAAGACCATCATCGTGCACCTGAACGAGTCCGTGAAGATCGAG
TGCACCCGCCCGTCGAACAACACGCGCACCTCCATCCGGATCGGCCCTGGCCAGGCCTTCTACGCCACCGGCCAGGTGA
TCGGCGACATCCGCGAGGCGCACTGCAACATCTCGGAGTCCAAGTGGAACGAGACCCTGCAGCGCGTGTCCAAGAAGCT
GAAGGAGTACTTCCCCCACAAGAACATCACCTTCCAGCCGTCGTCCGGCGGCGACCTCGAGATCACCACGCACTCCTTC
AACTGCGGTGGCGAGTTCTTCTACTGCAACACGTCGTCGCTGTTCAACCGCACCTACATGGCCAACTCCACCGAGACCA
ACTCCACGCGCATCATCACGATCCGCTGCCGCATCAAGCAGATCATCAACATGTGGCAGGAGGTGGGCCGCGCCATGTA
CGCACCGCCCATCGCCGGCAACATCACCTGCATCTCCAACATCACCGGCCTCCTGCTGACCCGCGACGGCGGCAACAAC
AACACGGAGACCTTCAGGCCAGGCGGAGGCAACATGAAGGACAACTGGCGCTCCGAGCTGTACAAGTACAAGGTGGTGG
AGGTGAAGCCCCTGGGCGTGGCACCCACCAACGCCCGCGAGCGCGTCGTGGAGCGCGAGAAGGAGTAGTAAGaattcgg
tgaccgggacctggatcc >HV1300531_v2, CH505.M5D8gp120 (SEQ ID NO. 115)

MRVMGIQRNYPQWWIWSMLGFWMLMICNGVPVWKEAKTTLFCASDAKAYEKEVHNVWATHACVPTDPNPQEMVLKNV
TENFNMWKNDMVDQMHEDVISLWDQSLKPCVKLTPLCVTLNCTNATASNSSIIEGMKNCSFNITTELRDKREKKNAL
FYKLDIVQLDGNSSQYRLINCNTSVITQACPKVSFDPIPIHYCAPAGYAILKCNNKTFTGTGPCNNVSTVQCTHGIK
PVVSTQLLLNGSLAEGEIIIRSENITKNVKTIIVHLNESVKIECTRPNNKTRTSIRIGPGQAFYATGQVIGDIREAY
CNINESKWNETLQRVSKKLKEYFPHKNITFQPSSGGDLEITTHSFNCGGEFFYCNTSSLFNRTYMANSTDMANSTET
NSTRTITIHCRIKQIINMWQEVGRAMYAPPIAGNITCISNITGLLLTRDGGKNNTETFRPGGGNMKDNWRSELYKYK
VVEVKPLGVAPTNARERVVEREKE*

>HV1300537_v2, CH505.M11D8gp120 (SEQ ID NO. 116)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLNCTNATASNSSIIEGMKNCSFNITTELRDKREKKNALFYKL
DIVQLDGNSSQYRLINCNTSVITQACPKVSFDPIPIHYCAPAGYAILKCNNKTFTGTGPCNNVSTVQCTHGIKPVVSTQ
LLLNGSLAEGEIIIRSENITDNGKTIIVHLNESVKIECTRPNNKTRTSIRIGPGQAFYATGQVIGDIREAYCNINESKW
NETLQRVSKKLKEYFPHKNITFQPSSGGDLEITTHSFNCGGEFFYCNTSSLFNRTYMANSTDMANSTETNSTRTITIHC
RIKQIINMWQEVGRAMYAPPIAGNITCISNITGLLLTRDGGKNNTETFRPGGGNMKDNWRSELYKYKVVEVKPLGVAPT
NARERVVEREKE*

Figure 2B cont.

>HV1300556_v2, CH505w020.14D8gp120 (SEQ ID NO. 117)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLNCTNATASNNSIIEGMKNCSFNITTELRDKREKKNALFYKL
DIVQLDGNSSQYRLINCNTSVITQACPKVSFDPIPIHYCAPAGYAILKCNNKTFTGTGPCNNVSTVQCTHGIKPVVSTQ
LLLNGSLAEGEIIIRSENITNNAKTIIVHLNESVKIECTRPNNKTRTSIRIGPGQAFYATGQVIGDIRKAYCNISESKW
NETLQRVSKKLKEYFPHKNITFQPSSGGDLEITTHSFNCGGEFFYCNTSSLFNRTYMANSTDMANSTETNSTRTITLHC
RIKQIINMWQEVGRAMYAPPIAGNITCISNITGLLLTRDGGKNNTETFRPGGGNMKDNWRSELYKYKVVEVKPLGVAPT
NARERVVEREKE*

>HV1300578_v2, CH505w030.28D8gp120 (SEQ ID NO. 118)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKMTPLCVTLNCTNATAINSSIIEGMKNCSFNITTELRDKREKKNALFYKL
DIVQLDGNSSQYRLINCNTSVITQACPKVSFDPIPIHYCAPAGYAILKCNNKTFTGTGPCNNVSTVQCTHGIKPVVSTQ
LLLNGSLAEGEIIIRSENITNNDKTIIVHLNESVKIECTRPNNKTRTSIRIGPGQAFYATGQVIGDIREAHCNISESKW
NETLQRVSKKLKEYFPHKNITFQPSSGGDLEITTHSFNCGGEFFYCNTSSLFNRTYMANSTDMANSTETNSTRTITIRC
RIKQIINMWQEVGRAMYAPPIAGNITCISNITGLLLTRDGGKNNTETFRPGGGNMKDNWRSELYKYKVVEVKPLGVAPT
NARERVVEREKE*

>HV1300592, CH505w078.15D8gp120 (SEQ ID NO. 119)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLSCTNATNATASNSSILEGMKNCSFNITTELRDKREKKNALF
YKLDIVQLDGNSSQYRLINCNTSVITQACPKVSFDPIPIHYCAPAGYAILKCNNKTFNGTGPCNNVSTVQCTHGIKPVV
STQLLLNGSLAEGEIIIRSKNITDNGKTIIVHLNESVKIECTRPSNNTRTSIRIGPGQAFYATGQVIGDIREAHCNISE
SKWNETLQRVSEKLKEYFPHKNITFQPSSGGDLEITTHSFNCGGEFFYCNTSSLFNRTYMATSTDMANSTETNSTRIIT
IRCRIKQIINMWQEVGRAMYAPPIAGNITCISNITGLLLTRDGGKNDTDTFRPEGGNMKDNWRSELYKYKVVEVKPLGV
APTNARERVVEREKE*

>HV1300583, CH505w053.16D8gp120 (SEQ ID NO. 120)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLNCTNANATASNSSIIEGMNSSIIEGMKNCSFNITTELRDKR
EKKNALFYKLDIVQLDGNSSQYRLINCNTSVITQACPKVSFDPIPIHYCAPAGYAILKCNNKTFNGTGPCNNVSTVQCT
HGIKPVVSTQLLLNGSLAEGEIIIRSENITDNGKTIIVHLNESVKIECTRPSNNTRTSIRIGPGQAFYATGQVIGDIRE
AHCNISESKWNETLQRVSEKLKEYFPHKNITFQPSSGGDLEITTHSFNCGGEFFYCNTSSLFNRTYMATSTDMANSTET
NSTRIITIRCRIKQIINMWQEVGRAMYAPPIAGNITCISNITGLLLTRDGGKNNTETFETFRPGGGNMKDNWRSELYKY
KVVEVKPLGVAPTNARERVVEREKE*

Figure 2B cont.

>HV1300574_v2, CH505w030.21D8gp120 (SEQ ID NO. 121)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLNCTNATTNATASNSSIIEEMKNCSFNITTELRDKREKKNAL
FYKLDIVQLDGNSSQYRLINCNTSVITQACPKVSFDPIPIHYCAPAGYAILKCNNKTFTGTGPCNNVSTVQCTHGIKPV
VSTQLLLNGSLAEGEIIIRSENITNTAKTIIVHLNESVKIECTRPNNKTRTSIRIGPGQAFYATGQVIGDIREAYCNIS
ESKWNETLQRVSKKLKEYFPHKNITFQPSSGGDLEITTHSFNCGGEFFYCNTSSLFNRTYMANSTDMANSTETNSTRTI
TIRCRIKQIINMWQEVGRAMYAPPIAGNITCISNITGLLLTRDGGENNTETFRPGGGNMKDNWRSELYKYKVVEVKPLG
VAPTNARERVVEREKE*

>HV1300595, CH505w078.33D8gp120 (SEQ ID NO. 122)

MRVTGIQRNYPQWWIWSMLGLWMLMICNGVPVWKEAKTTLFCASDAKAYEKEVHNVWATHACVPTDPNPQEMVLKNVTE
NFNMWKNDMADQMHEDVISLWDQSLKPCVKLTPLCVTLNCIDANATASNATASNSSIIEGMKNCSFNITTELRDKIEKK
NALFYKLDIVQLDGNSSQYRLINCNTSVITQACPKVSFDPIPIHYCAPAGYAILKCNNKTFNGTGPCNNVSTVQCTHGI
KPVVSTQLLLNGSLAEGEIIIRSENITNSAKTIIVHLNESVKIECTRPSNNTRTSIRIGPGQAFYATGQVIGDIRKAHC
NISESKWNETLQRVSKKLKEYFPHKNITFQPSSGGDLEITTHSFNCGGEFFYCNTSSLFNRTYMANSTETNSTRTITLH
CRIKQIINMWQEVGRAMYAPPIAGNITCISNITGLLLTRDGGNNNTTETFRPGGGNMKDNWRSELYKYKVVEIKPLGVA
PTNARERVVEREKE*

>HV1300605, CH505w100.B6D8gp120 (SEQ ID NO. 123)

MKVRGIQRNYPQWWIWSMLGLWMLMICNGVPVWKEAKTTLFCASDAKAYEKEVHNVWATHACVPTDPNPQEMVLENVTE
NFNMWKNDMADQMHEDVISLWDQSLKPCVKLTPLCVTLNCTDANATASNTNATASNINATASKSSIIEEMKNCSFNITT
ELRDKREKKYALFYKLDIVQLDGNSSQYRLINCNTSVITQACPKVSFDPIPIHYCAPAGYAILKCNNKTFNGTGPCNNV
STVQCTHGIKPVVSTQLLLNGSLAEGEIIIRSENITDNSKTIIVHLNESVKIECTRPSNNTRTSIRIGPGQAFYATGQV
IGDIREAHCNISESKWNETLQRVSKKLKEYFPDKNITFQPSSGGDPEITTHSFNCGGEFFYCNTSSLFNRTYMANSTET
NSTRTITLHCRIKQIINMWQEVGRAMYAPPIAGNITCISNITGLLLTRDGGENTRDGGNNNTETFRPEGGNMKDNWRSE
LYKYKVVEVKPLGVAPTKARERVVEREKE*

>HV1300586, CH505w053.31D8gp120 (SEQ ID NO. 124)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLNCTDATASNATASNATASNSSIIEGMKNCSFNITTELRDKR
EKKNALFYKLDIVQLDGNSSQYRLINCNTSVITQACPKVSFDPIPIHYCAPAGYAILKCNNKTFNGTGPCNNVSTVQCT
HGIKPVVSTQLLLNGSLAEGEIIIRSENITDNGKTIIVHLNESVKIECTRPSNNTRTSIRIGPGQAFYATGQVIGDIRE
AHCNISESKWNETLQRVSKKLKEYFPHKNITFQPSSGGDLEITTHSFNCGGEFFYCNTSSLFNRTYMANSTETNSTRII
TIRCRIKQIINMWQEVGRAMYAPPIAGNITCISNITGLLLTRDGGNNNTETFRPGGGNMKDNWRSELYKYKVVEVKPLG
VAPTNARERVVEREKE*

Figure 2B cont.

gp160 constructs:

>CH505.M5gp160 (SEQ ID NO. 125)

gtcgacaagaaATGCGCGTGATGGGCATCCAGCGCAACTACCCGCAGTGGTGGATCTGGTCGATGCTGGGCTTCTGGAT
GCTCATGATCTGCAACGGCATGTGGGTGACGGTGTACTACGGCGTGCCGGTGTGGAAGGAGGCCAAGACGACCCTGTTC
TGCGCGTCGGACGCCAAGGCCTACGAGAAGGAGGTGCACAACGTGTGGGCGACCCACGCCTGCGTGCCCACGGACCCCA
ACCCGCAGGAGATGGTGCTGAAGAACGTGACCGAGAACTTCAACATGTGGAAGAACGACATGGTGGACCAGATGCACGA
GGACGTGATCTCCCTGTGGGACCAGTCCCTGAAGCCCTGCGTGAAGCTGACCCCGCTGTGCGTGACCCTGAACTGCACC
AACGCCACCGCGTCCAACTCCTCCATCATCGAGGGCATGAAGAACTGCTCCTTCAACATCACGACGGAGCTGCGCGACA
AGCGCGAGAAGAAGAACGCCCTGTTCTACAAGCTGGACATCGTGCAGCTGGACGGCAACTCCTCGCAGTACAGGCTGAT
CAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGT
GCACGCACGGGATCAAGCCCGTGGTGTCCACGCAGCTGCTCCTGAACGGGTCGCTGGCCGAGGGCGAGATCATCATCCG
GTCCGAGAACATCACGAAGAACGTGAAGACCATCATCGTGCACCTGAACGAGTCCGTGAAGATCGAGTGCACCCGCCCG
AACAACAAGACGCGCACCTCCATCCGGATCGGCCCTGGCCAGGCCTTCTACGCCACCGGCCAGGTGATCGGCGACATCC
GCGAGGCGTACTGCAACATCAACGAGTCCAAGTGGAACGAGACCCTGCAGCGCGTGTCCAAGAAGCTGAAGGAGTACTT
CCCCCACAAGAACATCACCTTCCAGCCGTCGTCCGGCGGCGACCTCGAGATCACCACGCACTCCTTCAACTGCGGTGGC
GAGTTCTTCTACTGCAACACGTCGTCGCTGTTCAACCGCACCTACATGGCCAACTCCACCGACATGGCCAACTCCACCG
AGACCAACTCCACGCGCACCATCACGATCCACTGCCGCATCAAGCAGATCATCAACATGTGGCAGGAGGTGGGCCGCGC
CATGTACGCACCGCCCATCGCCGGCAACATCACCTGCATCTCCAACATCACCGGCCTCCTGCTGACCCGCGACGGCGGC
AAGAACAACACGGAGACCTTCAGGCCAGGCGGAGGCAACATGAAGGACAACTGGCGCTCCGAGCTGTACAAGTACAAGG
TGGTGGAGGTGAAGCCCCTGGGCGTGGCACCCACCAACGCCCGCAGGCGCGTCGTGGAGCGCGAGAAGCGCGCCGTGGG
CATGGGCGCCGTGTTCCTGGGCTTCCTGGGCGCTGCGGGCTCCACCATGGGTGCCGCGTCCATCACCCTGACCGTGCAG
GCCCGCCAGCTGCTCTCCGGCATCGTGCAGCAGCAGTCCAACCTCCTGAAGGCCATCGAGGCCCAGCAGCACATGCTGA
AGCTGACCGTGTGGGGCATCAAGCAGCTGCAGGCCAGGGTGCTCGCGCTCGAGCGCTACCTGAAGGACCAGCAGCTGCT
CGGCATGTGGGGCTGCTCCGGCAAGCTGATCTGCACCACCAACGTGTACTGGAACTCGTCCTGGTCCAACAAGACCTAC
GGCGACATCTGGGACAACATGACCTGGATGCAGTGGGAGCGCGAGATCTCCAACTACACCGAGATCATCTACGAGCTCC
TCGAGGAGTCCCAGAACCAGCAGGAGAAGAACGAGCAGGATCTGCTCGCGCTGGACCGCTGGAACTCCCTGTGGAACTG
GTTCAACATCACCAACTGGCTGTGGTACATCAAGATCTTCATCATGATCGTGGGCGGCCTGATCGGCCTGCGCATCATC
TTCGCCGTGCTGTCGCTGGTGAACCGCGTGCGCCAGGGCTACTCCCCGCTGTCCCTGCAAACGCTGATCCCCTCCCCCC
GGGGCCCGGACAGGCCCGGTGGCATCGAGGAGGAGGGCGGCGAGCAGGACCGCAACCGCTCCACGCGCCTGGTGTCCGG
CTTCCTGGCCCTGGTGTGGGACGACCTGCGCTCCCTGTGCCTGTTCATCTACCACCGCCTGCGCGACTTCATCCTGATC
GCGGCCCGCGCTGGCGAGCTGCTGGGCCGGTCCTCGCTGAAGGGCCTGCGCCGCGGCTGGGAGGCCCTGAAGTACCTGG
GCTCGCTGGTGCAGTACTGGGGCCTGGAGCTGAAGCGCTCCGCCATCTCCCTGCTGGACACCCTGGCCATCGCCGTGGG
CGAGGGCACCGACCGCATCCTGGAGTTCGTGCTGGGCATCTGCCGCGCCATCCGCAACATCCCCACCCGCATCCGCCAG
GGCTTCGAGACCGCCCTCCTGTAGTAAGgtgaccgaattcgggacccggatcc

Figure 2C

>CH505.M11gp160 (SEQ ID NO. 126)

gtcgacaagaaATGCGCGTGATGGGCATCCAGCGCAACTACCCGCAGTGGTGGATCTGGTCGATGCTGGGCTTCTGGAT
GCTCATGATCTGCAACGGCATGTGGGTGACGGTGTACTACGGCGTGCCGGTGTGGAAGGAGGCCAAGACGACCCTGTTC
TGCGCGTCGGACGCCAAGGCCTACGAGAAGGAGGTGCACAACGTGTGGGCGACCCACGCCTGCGTGCCCACGGACCCCA
ACCCGCAGGAGATGGTGCTGAAGAACGTGACCGAGAACTTCAACATGTGGAAGAACGACATGGTGGACCAGATGCACGA
GGACGTGATCTCCCTGTGGGACCAGTCCCTGAAGCCCTGCGTGAAGCTGACCCCGCTGTGCGTGACCCTGAACTGCACC
AACGCCACCGCGTCCAACTCCTCCATCATCGAGGGCATGAAGAACTGCTCCTTCAACATCACGACGGAGCTGCGCGACA
AGCGCGAGAAGAAGAACGCCCTGTTCTACAAGCTGGACATCGTGCAGCTGGACGGCAACTCCTCGCAGTACAGGCTGAT
CAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGT
GCACGCACGGGATCAAGCCCGTGGTGTCCACGCAGCTGCTCCTGAACGGGTCGCTGGCCGAGGGCGAGATCATCATCCG
GTCCGAGAACATCACGGACAACGGGAAGACCATCATCGTGCACCTGAACGAGTCCGTGAAGATCGAGTGCACCCGCCCG
AACAACAAGACGCGCACCTCCATCCGGATCGGCCCTGGCCAGGCCTTCTACGCCACCGGCCAGGTGATCGGCGACATCC
GCGAGGCGTACTGCAACATCAACGAGTCCAAGTGGAACGAGACCCTGCAGCGCGTGTCCAAGAAGCTGAAGGAGTACTT
CCCCCACAAGAACATCACCTTCCAGCCGTCGTCCGGCGGCGACCTCGAGATCACCACGCACTCCTTCAACTGCGGTGGC
GAGTTCTTCTACTGCAACACGTCGTCGCTGTTCAACCGCACCTACATGGCCAACTCCACCGACATGGCCAACTCCACCG
AGACCAACTCCACGCGCACCATCACGATCCACTGCCGCATCAAGCAGATCATCAACATGTGGCAGGAGGTGGGCCGCGC
CATGTACGCACCGCCCATCGCCGGCAACATCACCTGCATCTCCAACATCACCGGCCTCCTGCTGACCCGCGACGGCGGC
AAGAACAACACGGAGACCTTCAGGCCAGGCGGAGGCAACATGAAGGACAACTGGCGCTCCGAGCTGTACAAGTACAAGG
TGGTGGAGGTGAAGCCCCTGGGCGTGGCACCCACCAACGCCCGCAGGCGCGTCGTGGAGCGCGAGAAGCGCGCCGTGGG
CATGGGCGCCGTGTTCCTGGGCTTCCTGGGCGCTGCGGGCTCCACCATGGGTGCCGCGTCCATCACCCTGACCGTGCAG
GCCCGCCAGCTGCTCTCCGGCATCGTGCAGCAGCAGTCCAACCTCCTGAAGGCCATCGAGGCCCAGCAGCACATGCTGA
AGCTGACCGTGTGGGGCATCAAGCAGCTGCAGGCCAGGGTGCTCGCGCTCGAGCGCTACCTGAAGGACCAGCAGCTGCT
CGGCATGTGGGGCTGCTCCGGCAAGCTGATCTGCACCACCAACGTGTACTGGAACTCGTCCTGGTCCAACAAGACCTAC
GGCGACATCTGGGACAACATGACCTGGATGCAGTGGGAGCGCGAGATCTCCAACTACACCGAGATCATCTACGAGCTCC
TCGAGGAGTCCCAGAACCAGCAGGAGAAGAACGAGCAGGATCTGCTCGCGCTGGACCGCTGGAACTCCCTGTGGAACTG
GTTCAACATCACCAACTGGCTGTGGTACATCAAGATCTTCATCATGATCGTGGGCGGCCTGATCGGCCTGCGCATCATC
TTCGCCGTGCTGTCGCTGGTGAACCGCGTGCGCCAGGGCTACTCCCCGCTGTCCCTGCAAACGCTGATCCCCTCCCCCC
GGGGCCCGGACAGGCCCGGTGGCATCGAGGAGGAGGGCGGCGAGCAGGACCGCAACCGCTCCACGCGCCTGGTGTCCGG
CTTCCTGGCCCTGGTGTGGGACGACCTGCGCTCCCTGTGCCTGTTCATCTACCACCGCCTGCGCGACTTCATCCTGATC
GCGGCCCGCGCTGGCGAGCTGCTGGGCCGGTCCTCGCTGAAGGGCCTGCGCCGCGGCTGGGAGGCCCTGAAGTACCTGG
GCTCGCTGGTGCAGTACTGGGGCCTGGAGCTGAAGCGCTCCGCCATCTCCCTGCTGGACACCCTGGCCATCGCCGTGGG
CGAGGGCACCGACCGCATCCTGGAGTTCGTGCTGGGCATCTGCCGCGCCATCCGCAACATCCCCACCCGCATCCGCCAG
GGCTTCGAGACCGCCCTCCTGTAGTAAGgtgaccgaattcaggtcccggatcc

Figure 2C cont.

>CH505w020.14gp160 (SEQ ID NO. 127)

gtcgacaagaaATGCGCGTGATGGGCATCCAGCGCAACTACCCGCAGTGGTGGATCTGGTCGATGCTGGGCTTCTGGAT
GCTCATGATCTGCAACGGCATGTGGGTGACGGTGTACTACGGCGTGCCGGTGTGGAAGGAGGCCAAGACGACCCTGTTC
TGCGCGTCGGACGCCAAGGCCTACGAGAAGGAGGTGCACAACGTGTGGGCGACCCACGCCTGCGTGCCCACGGACCCCA
ACCCGCAGGAGATGGTGCTGAAGAACGTGACCGAGAACTTCAACATGTGGAAGAACGACATGGTGGACCAGATGCACGA
GGACGTGATCTCCCTGTGGGACCAGTCCCTGAAGCCCTGCGTGAAGCTGACCCCGCTGTGCGTGACCCTGAACTGCACC
AACGCCACCGCGTCCAACAACTCCATCATCGAGGGCATGAAGAACTGCTCCTTCAACATCACGACGGAGCTGCGCGACA
AGCGCGAGAAGAAGAACGCCCTGTTCTACAAGCTGGACATCGTGCAGCTGGACGGCAACTCCTCGCAGTACAGGCTGAT
CAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGT
GCACGCACGGGATCAAGCCCGTGGTGTCCACGCAGCTGCTCCTGAACGGGTCGCTGGCCGAGGGCGAGATCATCATCCG
GTCCGAGAACATCACGAACAACGCGAAGACCATCATCGTGCACCTGAACGAGTCCGTGAAGATCGAGTGCACCCGCCCG
AACAACAAGACGCGCACGTCCATCCGGATCGGCCCTGGCCAGGCCTTCTACGCCACCGGCCAGGTGATCGGCGACATCC
GCAAGGCGTACTGCAACATCTCGGAGTCCAAGTGGAACGAGACCCTGCAGCGCGTGTCCAAGAAGCTGAAGGAGTACTT
CCCCCACAAGAACATCACCTTCCAGCCGTCGTCCGGCGGCGACCTCGAGATCACCACGCACTCCTTCAACTGCGGTGGC
GAGTTCTTCTACTGCAACACGTCGTCGCTGTTCAACCGCACCTACATGGCCAACTCCACCGACATGGCCAACTCCACCG
AGACCAACTCCACGCGCACCATCACGCTCCACTGCCGCATCAAGCAGATCATCAACATGTGGCAGGAGGTGGGCCGCGC
CATGTACGCACCGCCCATCGCCGGCAACATCACCTGCATCTCCAACATCACCGGCCTCCTGCTGACCCGCGACGGCGGC
AAGAACAACACGGAGACCTTCAGGCCAGGCGGAGGCAACATGAAGGACAACTGGCGCTCCGAGCTGTACAAGTACAAGG
TGGTGGAGGTGAAGCCCCTGGGCGTGGCACCCACCAACGCCCGCAGGCGCGTCGTGGAGCGCGAGAAGCGCGCCGTGGG
CATGGGCGCCGTGTTCCTGGGCTTCCTGGGCGCTGCGGGCTCCACCATGGGTGCCGCGTCCATCACCCTGACCGTGCAG
GCCCGCCAGCTGCTCTCCGGCATCGTGCAGCAGCAGTCCAACCTCCTGAAGGCCATCGAGGCCCAGCAGCACATGCTGA
AGCTGACCGTGTGGGGCATCAAGCAGCTGCAGGCCAGGGTGCTCGCGCTCGAGCGCTACCTGAAGGACCAGCAGCTGCT
CGGCATGTGGGGCTGCTCCGGCAAGCTGATCTGCACCACCAACGTGTACTGGAACTCGTCCTGGTCCAACAAGACCTAC
GGCGACATCTGGGACAACATGACCTGGATGCAGTGGGAGCGCGAGATCTCCAACTACACCGAGATCATCTACGAGCTCC
TCGAGGAGTCCCAGAACCAGCAGGAGAAGAACGAGCAGGATCTGCTCGCGCTGGACCGCTGGAACTCCCTGTGGAACTG
GTTCAACATCACCAACTGGCTGTGGTACATCAAGATCTTCATCATGATCGTGGGCGGCCTGATCGGCCTGCGCATCATC
TTCGCCGTGCTGTCGCTGGTGAACCGCGTGCGCCAGGGCTACTCCCCGCTGTCCCTGCAAACGCTGATCCCCTCCCCCC
GGGGCCCGGACAGGCCCGGTGGCATCGAGGAGGAGGGCGGCGAGCAGGACCGCAACCGCTCCACGCGCCTGGTGTCCGG
CTTCCTGGCCCTGGTGTGGGACGACCTGCGCTCCCTGTGCCTGTTCATCTACCACCGCCTGCGCGACTTCATCCTGATC
GCGGCCCGCGCTGGCGAGCTGCTGGGCCGGTCCTCGCTGAAGGGCCTGCGCCGCGGCTGGGAGGCCCTGAAGTACCTGG
GCTCGCTGGTGCAGTACTGGGGCCTGGAGCTGAAGCGCTCCGCCATCTCCCTGCTGGACACCCTGGCCATCGCCGTGGG
CGAGGGCACCGACCGCATCCTGGAGTTCGTGCTGGGCATCTGCCGCGCCATCCGCAACATCCCCACCCGCATCCGCCAG
GGCTTCGAGACCGCCCTCCTGTAGTAAGggacccgaattcggtcaccggatcc

Figure 2C cont.

>CH505w030.28gp160 (SEQ ID NO. 128)

gtcgacaagaaATGCGCGTGATGGGCATCCAGCGCAACTACCCGCAGTGGTGGATCTGGTCGATGCTGGGCTTCTGGAT
GCTCATGATCTGCAACGGCATGTGGGTGACGGTGTACTACGGCGTGCCGGTGTGGAAGGAGGCCAAGACGACCCTGTTC
TGCGCGTCGGACGCCAAGGCCTACGAGAAGGAGGTGCACAACGTGTGGGCGACCCACGCCTGCGTGCCCACGGACCCCA
ACCCGCAGGAGATGGTGCTGAAGAACGTGACCGAGAACTTCAACATGTGGAAGAACGACATGGTGGACCAGATGCACGA
GGACGTGATCTCCCTGTGGGACCAGTCCCTGAAGCCCTGCGTGAAGATGACCCCGCTGTGCGTGACCCTGAACTGCACC
AACGCCACCGCGATCAACTCCTCCATCATCGAGGGCATGAAGAACTGCTCCTTCAACATCACGACGGAGCTGCGCGACA
AGCGCGAGAAGAAGAACGCCCTGTTCTACAAGCTGGACATCGTGCAGCTGGACGGCAACTCCTCGCAGTACAGGCTGAT
CAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGT
GCACGCACGGGATCAAGCCCGTGGTGTCCACGCAGCTGCTCCTGAACGGGTCGCTGGCCGAGGGCGAGATCATCATCCG
GTCCGAGAACATCACGAACAACGACAAGACCATCATCGTGCACCTGAACGAGTCCGTGAAGATCGAGTGCACCCGCCCG
AACAACAAGACGCGCACCTCCATCCGGATCGGCCCTGGCCAGGCCTTCTACGCCACCGGCCAGGTGATCGGCGACATCC
GCGAGGCGCACTGCAACATCTCGGAGTCCAAGTGGAACGAGACCCTGCAGCGCGTGTCCAAGAAGCTGAAGGAGTACTT
CCCCCACAAGAACATCACCTTCCAGCCGTCGTCCGGCGGCGACCTCGAGATCACCACGCACTCCTTCAACTGCGGTGGC
GAGTTCTTCTACTGCAACACGTCGTCGCTGTTCAACCGCACCTACATGGCCAACTCCACCGACATGGCCAACTCCACCG
AGACCAACTCCACGCGCACCATCACGATCCGCTGCCGCATCAAGCAGATCATCAACATGTGGCAGGAGGTGGGCCGCGC
CATGTACGCACCGCCCATCGCCGGCAACATCACCTGCATCTCCAACATCACCGGCCTCCTGCTGACCCGCGACGGCGGC
AAGAACAACACGGAGACCTTCAGGCCAGGCGGAGGCAACATGAAGGACAACTGGCGCTCCGAGCTGTACAAGTACAAGG
TGGTGGAGGTGAAGCCCCTGGGCGTGGCACCCACCAACGCCCGCAGGCGCGTCGTGGAGCGCGAGAAGCGCGCCGTGGG
CATGGGCGCCGTGTTCCTGGGCTTCCTGGGCGCTGCGGGCTCCACCATGGGTGCCGCGTCCATCACCCTGACCGTGCAG
GCCCGCCAGCTGCTCTCCGGCATCGTGCAGCAGCAGTCCAACCTCCTGAAGGCCATCGAGGCCCAGCAGCACATGCTGA
AGCTGACCGTGTGGGGCATCAAGCAGCTGCAGGCCAGGGTGCTCGCGCTCGAGCGCTACCTGAAGGACCAGCAGCTGCT
CGGCATGTGGGGCTGCTCCGGCAAGCTGATCTGCACCACCAACGTGTACTGGAACTCGTCCTGGTCCAACAAGAGCTAC
GGCGACATCTGGGACAACATGACCTGGATGCAGTGGGAGCGCGAGATCTCCAACTACACCGAGATCATCTACGAGCTCC
TCGAGGAGTCCCAGAACCAGCAGGAGAAGAACGAGCAGGATCTGCTCGCGCTGGACCGCTGGAACTCCCTGTGGAACTG
GTTCAACATCACCAACTGGCTGTGGTACATCAAGATCTTCATCATGATCGTGGGCGGCCTGATCGGCCTGCGCATCATC
TTCGCCGTGCTGTCGCTGGTGAACCGCGTGCGCCAGGGCTACTCCCCGCTGTCCCTGCAAACGCTGATCCCCTCCCCCC
GGGGCCCGGACAGGCCCGGTGGCATCGAGGAGGAGGGCGGCGAGCAGGACCGCAACCGCTCCACGCGCCTGGTGTCCGG
CTTCCTGGCCCTGGTGTGGGACGACCTGCGCTCCCTGTGCCTGTTCATCTACCACCGCCTGCGCGACTTCATCCTGATC
GCGGCCCGCGCTGGCGAGCTGCTGGGCCGGTCCTCGCTGAAGGGCCTGCGCCGCGGCTGGGAGGCCCTGAAGTACCTGG
GCTCGCTGGTGCAGTACTGGGGCCTGGAGCTGAAGCGCTCCGCCATCTCCCTGCTGGACACCCTGGCCATCGCCGTGGG
CGAGGGCACCGACCGCATCCTGGAGTTCGTGCTGGGCATCTGCCGCGCCATCCGCAACATCCCCACCCGCATCCGCCAG
GGCTTCGAGACCGCCCTCCTGTAGTAAGggtcctgaattcggttaccggatcc

Figure 2C cont.

>CH505w078.15gp160 (SEQ ID NO. 129)

gtcgacaagaaATGCGCGTGATGGGCATCCAGCGCAACTACCCGCAGTGGTGGATCTGGTCGATGCTGGGCTTCTGGAT
GCTCATGATCTGCAACGGCATGTGGGTGACGGTGTACTACGGCGTGCCGGTGTGGAAGGAGGCCAAGACGACCCTGTTC
TGCGCGTCGGACGCCAAGGCCTACGAGAAGGAGGTGCACAACGTGTGGGCGACCCACGCCTGCGTGCCCACGGACCCCA
ACCCGCAGGAGATGGTGCTGAAGAACGTGACCGAGAACTTCAACATGTGGAAGAACGACATGGTGGACCAGATGCACGA
GGACGTGATCTCCCTGTGGGACCAGTCCCTGAAGCCCTGCGTGAAGCTGACCCCGCTGTGCGTGACCCTGAGCTGCACG
AACGCCACCAACGCGACGGCGTCGAACTCGTCCATCCTCGAGGGGATGAAGAACTGCTCCTTCAACATCACGACGGAGC
TGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTAC
TGCGCCCCCGCCGGCTACGCCATCCTGAAGTGCAACAACAAGACCTTCAACGGCACCGGCCCGTGCAACAACGTGTCCA
CCGTGCAGTGCACGCACGGGATCAAGCCCGTGGTGTCCACGCAGCTGCTCCTGAACGGGTCGCTGGCCGAGGGCGAGAT
CATCATCCGGTCGAAGAACATCACGGACAACGGGAAGACCATCATCGTGCACCTGAACGAGTCCGTGAAGATCGAGTGC
ACCCGCCCGAGCAACAACACGCGCACCTCCATCCGGATCGGCCCTGGCCAGGCCTTCTACGCCACCGGCCAGGTGATCG
GCGACATCCGCGAGGCGCACTGCAACATCTCCGAGTCCAAGTGGAACGAGACCCTGCAGCGCGTGTCCGAGAAGCTGAA
GGAGTACTTCCCCCACAAGAACATCACCTTCCAGCCGTCGTCCGGCGGCGACCTCGAGATCACCACGCACTCCTTCAAC
TGCGGTGGCGAGTTCTTCTACTGCAACACGTCGTCGCTGTTCAACCGCACCTACATGGCCACCTCCACCGACATGGCCA
ACTCCACCGAGACCAACTCCACGCGCATCATCACGATCCGCTGCCGCATCAAGCAGATCATCAACATGTGGCAGGAGGT
GGGCCGCGCCATGTACGCACCGCCCATCGCCGGCAACATCACCTGCATCTCCAACATCACCGGCCTCCTGCTGACCCGC
GACGGCGGCAAGAACGACACGGACACCTTCAGGCCAGAGGGAGGCAACATGAAGGACAACTGGCGCTCCGAGCTGTACA
AGTACAAGGTGGTGGAGGTGAAGCCCCTGGGCGTGGCACCCACCAACGCCCGCAGGCGCGTCGTGGAGCGCGAGAAGCG
CGCCGTGGGCATGGGCGCCGTGTTCCTGGGCTTCCTGGGCGCTGCGGGCTCCACCATGGGTGCCGCGTCCATCACCCTG
ACCGTGCAGGCCCGCCAGCTGCTCTCCGGCATCGTGCAGCAGCAGTCCAACCTCCTGAAGGCCATCGAGGCCCAGCAGC
ACATGCTGAAGCTGACCGTGTGGGGCATCAAGCAGCTGCAGGCCAGGGTGCTCGCGCTCGAGCGCTACCTGAAGGACCA
GCAGCTGCTCGGCATGTGGGGCTGCTCCGGCAAGCTGATCTGCACCACCAACGTGTACTGGAACTCGTCCTGGTCCAAC
AAGACCTACGGCGACATCTGGGACAACATGACCTGGATGCAGTGGGAGCGCGAGATCTCCAACTACACCGAGCTGATCT
ACGAGCTCCTCGAGGAGTCCCAGAACCAGCAGGAGAAGAACGAGCAGGATCTGCTCGCGCTGGACCGCTGGAACTCCCT
GTGGAACTGGTTCAACATCACCAACTGGCTGTGGTACATCAAGATCTTCATCATGATCGTGGGCGGCCTGATCGGCCTG
CGCATCATCTTCGCCGTGCTGTCGCTGGTGAACCGCGTGCGCCAGGGCTACTCCCCGCTGTCCCTGCAAACGCTGATCC
CCTCCCCCCGGGGCCCGGACAGGCCCGGTGGCATCGAGGAGGAGGGCGGCGAGCAGGACCGCAACCGCTCCACGCGCCT
GGTGTCCGGCTTCCTGGCCCTGGCGTGGGACGACCTGCGCTCCCTGTGCCTGTTCATCTACCACCGCCTGCGCGACTTC
ATCCTGATCGCGGCCCGCGCTGGCGAGCTGCTGGGCCGGTCCTCGCTGAAGGGCCTGCGCCGCGGCTGGGAGGCCCTGA
AGTACCTGGGCAACCTGGTGCAGTACTGGGGCCTGGAGCTGAAGCGCTCCGCCATCTCCCTGCTGGACACCCTGGCCAT
CGCCGTGGGCGAGGGCACCGACCGCATCCTGGAGTTCGTGCTGGGCATCTGCCGCGCCATCCGCAACATCCCCACCCGC
ATCCGCCAGGGCTTCGAGACCGCCCTCCTGTAGTAAGaattcggtcaccgggtcctggatcc

Figure 2C cont.

>CH505w053.16gp160 (SEQ ID NO. 130)

gtcgacaagaaATGCGCGTGATGGGCATCCAGCGCAACTACCCGCAGTGGTGGATCTGGTCGATGCTGGGCTTCTGGAT
GCTCATGATCTGCAACGGCATGTGGGTGACGGTGTACTACGGCGTGCCGGTGTGGAAGGAGGCCAAGACGACCCTGTTC
TGCGCGTCGGACGCCAAGGCCTACGAGAAGGAGGTGCACAACGTGTGGGCGACCCACGCCTGCGTGCCCACGGACCCCA
ACCCGCAGGAGATGGTGCTGAAGAACGTGACCGAGAACTTCAACATGTGGAAGAACGACATGGTGGACCAGATGCACGA
GGACGTGATCTCCCTGTGGGACCAGTCCCTGAAGCCCTGCGTGAAGCTGACCCCGCTGTGCGTGACCCTGAACTGCACC
AACGCGAACGCCACCGCGTCCAACTCCTCTATCATCGAGGGGATGAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCT
GGACGGCAACTCCTCGCAGTACAGGCTGATCAACTGCAACACCTCCGTCATCACGCAGGCGTGCCCCAAGGTGTCCTTC
GACCCCATCCCCATCCACTACTGCGCCCCCGCCGGCTACGCCATCCTGAAGTGCAACAACAAGACCTTCAACGGCACCG
GCCCGTGCAACAACGTGTCCACCGTGCAGTGCACGCACGGGATCAAGCCCGTGGTGTCCACGCAGCTGCTCCTGAACGG
GTCGCTGGCCGAGGGCGAGATCATCATCCGGTCCGAGAACATCACGGACAACGGGAAGACCATCATCGTGCACCTGAAC
GAGTCCGTGAAGATCGAGTGCACCCGCCCGAGCAACAACACGCGCACCTCCATCCGGATCGGCCCTGGCCAGGCCTTCT
ACGCCACCGGCCAGGTGATCGGCGACATCCGCGAGGCGCACTGCAACATCTCGGAGTCCAAGTGGAACGAGACCCTGCA
GCGCGTGTCCGAGAAGCTGAAGGAGTACTTCCCCCACAAGAACATCACCTTCCAGCCGTCGTCCGGCGGCGACCTCGAG
ATCACCACGCACTCCTTCAACTGCGGTGGCGAGTTCTTCTACTGCAACACGTCGTCGCTGTTCAACCGCACCTACATGG
CCACGTCCACCGACATGGCCAACTCCACCGAGACCAACTCCACGCGCATCATCACGATCCGGTGCCGCATCAAGCAGAT
CATCAACATGTGGCAGGAGGTGGGCCGCGCCATGTACGCACCGCCCATCGCCGGCAACATCACCTGCATCTCCAACATC
ACCGGCCTCCTGCTGACCCGCGACGGCGGCAAGAACAACACGGAGACCTTCGAGACGTTCAGGCCAGGCGGAGGCAACA
TGAAGGACAACTGGCGCTCCGAGCTGTACAAGTACAAGGTGGTGGAGGTGAAGCCCCTGGGCGTGGCACCCACCAACGC
CCGCAGGCGCGTCGTGGAGCGCGAGAAGCGCGCCGTGGGCATGGGCGCCGTGTTCCTGGGCTTCCTGGGCGCTGCGGGC
TCCACCATGGGTGCCGCGTCCATCACCCTGACCGTGCAGGCCCGCCAGCTGCTCTCCGGCATCGTGCAGCAGCAGTCCA
ACCTCCTGAAGGCCATCGAGGCCCAGCAGCACATGCTGAAGCTGACCGTGTGGGGCATCAAGCAGCTGCAGGCCAGGGT
GCTCGCGCTCGAGCGCTACCTGAAGGACCAGCAGCTGCTCGGCATGTGGGGCTGCTCCGGCAAGCTGATCTGCACCACC
AACGTGTACTGGAACTCGTCCTGGTCCAACAAGACCTACGGCGACATCTGGGACAACATGACCTGGATGCAGTGGGAGC
GCGAGATCTCCAACTACACCGAGATCATCTACGAGCTCCTCGAGGAGTCCCAGAACCAGCAGGAGAAGAACGAGCAGGA
TCTGCTCGCGCTGGACCGCTGGAACTCCCTGTGGAACTGGTTCAACATCACCAACTGGCTGTGGTACATCAAGATCTTC
ATCATGATCGTGGGCGGCCTGATCGGCCTGCGCATCATCTTCGCCGTGCTGTCGCTGGTGAACCGCGTGCGCCAGGGCT
ACTCCCCGCTGTCCCTGCAAACGCTGATCCCCTCCCCCCGGGGCCCGGACAGGCCCGGTGGCATCGAGGAGGAGGGCGG
CGAGCAGGACCGCAACCGCTCCACGCGCCTGGTGTCCGGCTTCCTGGCCCTGGCGTGGGACGACCTGCGCTCCCTGTGC
CTGTTCATCTACCACCGCCTGCGCGACTTCATCCTGATCGCGGCCCGCGCTGGCGAGCTGCTGGGCCGGTCCTCGCTGA
AGGGCCTGCGCCGCGGCTGGGAGGCCCTGAAGTACCTGGGCTCGCTGGTGCAGTACTGGGGCCTGGAGCTGAAGCGCTC
CGCCATCTCCCTGCTGGACACCCTGGCCATCGCCGTGGGCGAGGGCACCGACCGCATCCTGGAGTTCGTGCTGGGCATC
TGCCGCGCCATCCGCAACATCCCCACCCGCATCCGCCAGGGCTTCGAGACCGCCCTCCTGTAGTAAGaattcggtgacc
gggtcccggatcc

Figure 2C cont.

>CH505w030.21gp160 (SEQ ID NO. 131)

gtcgacaagaaATGCGCGTGATGGGCATCCAGCGCAACTACCCGCAGTGGTGGATCTGGTCGATGCTGGGCTTCTGGAT
GCTCATGATCTGCAACGGCATGTGGGTGACGGTGTACTACGGCGTGCCGGTGTGGAAGGAGGCCAAGACGACCCTGTTC
TGCGCGTCGGACGCCAAGGCCTACGAGAAGGAGGTGCACAACGTGTGGGCGACCCACGCCTGCGTGCCCACGGACCCCA
ACCCGCAGGAGATGGTGCTGAAGAACGTGACCGAGAACTTCAACATGTGGAAGAACGACATGGTGGACCAGATGCACGA
GGACGTGATCTCCCTGTGGGACCAGTCCCTGAAGCCCTGCGTGAAGCTGACCCCGCTGTGCGTGACCCTGAACTGCACC
AACGCGACGACGAACGCCACCGCGTCCAACTCGTCCATCATCGAGGAGATGAAGAACTGCTCCTTCAACATCACGACGG
AGCTGCGCGACAAGCGCGAGAAGAAGAACGCCCTGTTCTACAAGCTGGACATCGTGCAGCTGGACGGCAACTCCTCGCA
GTACAGGCTGATCAACTGCAACACCTCCGTCATCACGCAGGCGTGCCCCAAGGTGTCCTTCGACCCCATCCCCATCCAC
TACTGCGCCCCCGCCGGCTACGCCATCCTGAAGTGCAACAACAAGACCTTCACCGGCACCGGCCCGTGCAACAACGTGT
CCACCGTGCAGTGCACGCACGGGATCAAGCCCGTGGTGTCCACGCAGCTGCTCCTGAACGGGTCGCTGGCCGAGGGCGA
GATCATCATCCGGTCCGAGAACATCACGAACACGGCGAAGACCATCATCGTGCACCTGAACGAGTCCGTGAAGATCGAG
TGCACCCGCCCGAACAACAAGACGCGCACCTCCATCCGGATCGGCCCTGGCCAGGCCTTCTACGCCACCGGCCAGGTGA
TCGGCGACATCCGCGAGGCGTACTGCAACATCTCGGAGTCCAAGTGGAACGAGACCCTGCAGCGCGTGTCCAAGAAGCT
GAAGGAGTACTTCCCCCACAAGAACATCACCTTCCAGCCGTCGTCCGGCGGCGACCTCGAGATCACCACGCACTCCTTC
AACTGCGGTGGCGAGTTCTTCTACTGCAACACGTCGTCGCTGTTCAACCGCACCTACATGGCCAACTCCACCGACATGG
CCAACTCCACCGAGACCAACTCCACGCGCACCATCACGATCCGGTGCCGCATCAAGCAGATCATCAACATGTGGCAGGA
GGTGGGCCGCGCCATGTACGCACCGCCCATCGCCGGCAACATCACCTGCATCTCCAACATCACCGGCCTCCTGCTGACC
CGCGACGGCGGCGAGAACAACACGGAGACCTTCAGGCCAGGCGGAGGCAACATGAAGGACAACTGGCGCTCCGAGCTGT
ACAAGTACAAGGTGGTGGAGGTGAAGCCCCTGGGCGTGGCACCCACCAACGCCCGCAGGCGCGTCGTGGAGCGCGAGAA
GCGCGCCGTGGGCATGGGCGCCGTGTTCCTGGGCTTCCTGGGCGCTGCGGGCTCCACCATGGGTGCCGCGTCCATCACC
CTGACCGTGCAGGCCCGCCAGCTGCTCTCCGGCATCGTGCAGCAGCAGTCCAACCTCCTGAAGGCCATCGAGGCCCAGC
AGCACATGCTGAAGCTGACCGTGTGGGGCATCAAGCAGCTGCAGGCCAGGGTGCTCGCGCTCGAGCGCTACCTGAAGGA
CCAGCAGCTGCTCGGCATGTGGGGCTGCTCCGGCAAGCTGATCTGCACCACCAACGTGTACTGGAACTCGTCCTGGTCC
AACAAGACCTACGGCGACATCTGGGACAACATGACCTGGATGCAGTGGGAGCGCGAGATCTCCAACTACACCGAGATCA
TCTACGAGCTCCTCGAGGAGTCCCAGAACCAGCAGGAGAAGAACGAGCAGGATCTGCTCGCGCTGGACCGCTGGAACTC
CCTGTGGAACTGGTTCAACATCACCAACTGGCTGTGGTACATCAAGATCTTCATCATGATCGTGGGCGGCCTGATCGGC
CTGCGCATCATCTTCGCCGTGCTGTCGCTGGTGAACCGCGTGCGCCAGGGCTACTCCCCGCTGTCCCTGCAAACGCTGA
TCCCCTCCCCCCGGGGCCCGGACAGGCCCGGTGGCATCGAGGAGGAGGGCGGCGAGCAGGACCGCAACCGCTCCACGCG
CCTGGTGTCCGGCTTCCTGGCCCTGGTGTGGGACGACCTGCGCTCCCTGTGCCTGTTCATCTACCACCGCCTGCGCGAC
TTCATCCTGATCGCGGCCCGCGCTGGCGAGCTGCTGGGCCGGTCCTCGCTGAAGGGCCTGCGCCGCGGCTGGGAGGCCC
TGAAGTACCTGGGCTCGCTGGTGCAGTACTGGGGCCTGGAGCTGAAGCGCTCCGCCATCTCCCTGCTGGACACCCTGGC
CATCGCCGTGGGCGAGGGCACCGACCGCATCCTGGAGTTCGTGCTGGGCATCTGCCGCGCCATCCGCAACATCCCCACC
CGCATCCGCCAGGGCTTCGAGACCGCCCTCCTGTAGTAAGggtcccgaattcggttaccggatcc

Figure 2C cont.

>CH505w078.33gp160 (SEQ ID NO. 132)

gtcgacaagaaATGCGCGTGACGGGCATCCAGCGCAACTACCCGCAGTGGTGGATCTGGTCGATGCTGGGCCTCTGGAT
GCTCATGATCTGCAACGGCATGTGGGTGACGGTGTACTACGGCGTGCCGGTGTGGAAGGAGGCCAAGACGACCCTGTTC
TGCGCGTCGGACGCCAAGGCCTACGAGAAGGAGGTGCACAACGTGTGGGCGACCCACGCCTGCGTGCCCACGGACCCCA
ACCCGCAGGAGATGGTGCTGAAGAACGTGACCGAGAACTTCAACATGTGGAAGAACGACATGGCGGACCAGATGCACGA
GGACGTGATCTCCCTGTGGGACCAGTCCCTGAAGCCCTGCGTGAAGCTGACCCCGCTGTGCGTGACCCTGAACTGCATC
GACGCCAACGCGACCGCGTCCAACGCGACGGCATCCAACTCGTCCATCATCGAGGGGATGAAGAACTGCTCCTTCAACA
TCACGACGGAGCTGCGCGACAAGATCGAGAAGAAGAACGCCCTGTTCTACAAGCTGGACATCGTGCAGCTGGACGGCAA
CTCCTCGCAGTACAGGCTGATCAACTGCAACACCTCCGTCATCACGCAGGCGTGCCCCAAGGTGTCCTTCGACCCCATC
CCCATCCACTACTGCGCCCCCGCCGGCTACGCCATCCTGAAGTGCAACAACAAGACCTTCAACGGCACCGGCCCGTGCA
ACAACGTGTCCACCGTGCAGTGCACGCACGGGATCAAGCCCGTGGTGTCCACGCAGCTGCTCCTGAACGGGTCGCTGGC
CGAGGGCGAGATCATCATCCGGTCGGAGAACATCACGAACAGCGCGAAGACCATCATCGTGCACCTGAACGAGTCCGTG
AAGATCGAGTGCACCCGCCCGAGCAACAACACGCGCACCTCCATCCGGATCGGCCCTGGCCAGGCCTTCTACGCCACCG
GCCAGGTGATCGGCGACATCCGCAAGGCGCACTGCAACATCTCCGAGTCCAAGTGGAACGAGACCCTGCAGCGCGTGTC
CAAGAAGCTGAAGGAGTACTTCCCCCACAAGAACATCACCTTCCAGCCGTCGTCCGGCGGCGACCTCGAGATCACCACG
CACTCCTTCAACTGCGGTGGCGAGTTCTTCTACTGCAACACGTCGTCGCTGTTCAACCGCACCTACATGGCCAACTCCA
CCGAGACCAACTCCACGCGCACGATCACGCTCCACTGCCGCATCAAGCAGATCATCAACATGTGGCAGGAGGTGGGCCG
CGCCATGTACGCACCGCCCATCGCCGGCAACATCACCTGCATCTCCAACATCACCGGCCTCCTGCTGACCCGCGACGGC
GGCAACAACAACACCACGGAGACCTTCAGGCCAGGGGGAGGCAACATGAAGGACAACTGGCGCTCCGAGCTGTACAAGT
ACAAGGTGGTGGAGATCAAGCCCCTGGGCGTGGCACCCACCAACGCCCGCAGGCGCGTCGTGGAGCGCGAGAAGCGCGC
CGTGGGCATGGGCGCCGTGTTCCTGGGCTTCCTGGGCGCTGCGGGCTCCACCATGGGTGCCGCGTCCATCACCCTGACC
GTGCAGGCCCGCCAGCTGCTCTCCGGCATCGTGCAGCAGCAGTCCAACCTCCTGAAGGCCATCGAGGCCCAGCAGCACA
TGCTGAAGCTGACCGTGTGGGGCATCAAGCAGCTGCAGGCCAGGGTGCTCGCGCTCGAGCGCTACCTGAAGGACCAGCA
GCTGCTCGGCATGTGGGGCTGCTCCGGCAAGCTGATCTGCACCACCAACGTGTACTGGAACTCGTCCTGGTCCAACAAG
ACCTACGGCGACATCTGGGACAACATGACCTGGATGCAGTGGGAGCGCGAGATCTCCGACTACACCGAGATCATCTACG
AGCTCCTCGAGGAGTCCCAGAACCAGCAGGAGAAGAACGAGCAGGATCTGCTCGCGCTGGACCGCTGGAACTCCCTGTG
GAACTGGTTCAACATCACCAACTGGCTGTGGTACATCAAGATCTTCATCATGATCGTGGGCGGCCTGATCGGCCTGCGC
ATCATCTTCGCCGTGCTGTCGCTGGTGAACCGCGTGCGCCAGGGCTACTCCCCGCTGTCCCTGCAAACGCTGACGCCCT
CCCCCCGGGGCCCGGACAGGCCCGGTGGCATCGAGGAGGAGGGCGGCGAGCAGGACCGCAACCGCTCCACGCGCCTGGT
GTCCGGCTTCCTGGCCCTGGCGTGGGACGACCTGCGCTCCCTGTGCCTGTTCATCTACCACCGCCTGCGCGACTTCATC
CTGATCGCGGCCCGCGCTGGCGAGCTGCTGGGCCGGTCCTCGCTGAAGGGCCTGCGCCGCGGCTGGGAGGCCCTGAAGT
ACCTGGGCGGCCTGGTGCAGTACTGGGGCCTGGAGCTGAAGCGCTCCGCCATCTCCCTGCTGGACACCCTGGCCATCGC
CGTGGGCGAGGGCACCGACCGCATCCTGGAGTTCGTGCTGGGCATCTGCCGCGCCATCCGCAACATCCCCACCCGCATC
CGCCAGGGCTTCGAGACCGCCCTCCTGTAGTAAGaattcggtaaccaggtcccggatcc

Figure 2C cont.

>CH505w100.B6gp160 (SEQ ID NO. 133)

gtcgacaagaaATGAAGGTGCGGGGCATCCAGCGCAACTACCCGCAGTGGTGGATCTGGTCGATGCTGGGCCTCTGGAT
GCTCATGATCTGCAACGGCATGTGGGTGACGGTGTACTACGGCGTGCCGGTGTGGAAGGAGGCCAAGACGACCCTGTTC
TGCGCGTCGGACGCCAAGGCCTACGAGAAGGAGGTGCACAACGTGTGGGCGACCCACGCCTGCGTGCCCACGGACCCCA
ACCCGCAGGAGATGGTGCTGGAGAACGTGACCGAGAACTTCAACATGTGGAAGAACGACATGGCGGACCAGATGCACGA
GGACGTGATCTCCCTGTGGGACCAGTCCCTGAAGCCCTGCGTGAAGCTGACCCCGCTGTGCGTGACCCTGAACTGCACG
GACGCCAACGCCACCGCGTCGAACACCAACGCGACCGCAAGCAACATCAACGCGACGGCGTCGAAGTCCTCCATCATCG
AGGAGATGAAGAACTGCTCCTTCAACATCACGACGGAGCTGCGCGACAAGCGCGAGAAGAAGTACGCCCTGTTCTACAA
GCTGGACATCGTGCAGCTGGACGGCAACTCCTCGCAGTACAGGCTGATCAACTGCAACACCTCCGTCATCACGCAGGCG
TGCCCCAAGGTGTCCTTCGACCCCATCCCCATCCACTACTGCGCCCCCGCCGGCTACGCCATCCTGAAGTGCAACAACA
AGACCTTCAACGGCACCGGCCCGTGCAACAACGTGTCCACCGTGCAGTGCACGCACGGGATCAAGCCCGTGGTGTCCAC
GCAGCTGCTCCTGAACGGGTCGCTGGCCGAGGGCGAGATCATCATCCGGTCGGAGAACATCACGGACAACAGCAAGACC
ATCATCGTGCACCTGAACGAGTCCGTGAAGATCGAGTGCACCCGCCCGAGCAACAACACGCGCACCTCCATCCGGATCG
GCCCTGGCCAGGCCTTCTACGCCACCGGCCAAGTGATCGGCGACATCCGCGAGGCGCACTGCAACATCTCCGAGTCCAA
GTGGAACGAGACCCTGCAGCGCGTGTCCAAGAAGCTGAAGGAGTACTTCCCCGACAAGAACATCACCTTCCAGCCGTCG
TCCGGCGGCGACCCCGAGATCACCACGCACTCCTTCAACTGCGGTGGCGAGTTCTTCTACTGCAACACGTCGTCCCTGT
TCAACCGCACCTACATGGCGAACTCCACCGAGACCAACTCCACGCGCACCATCACGCTGCACTGCCGCATCAAGCAGAT
CATCAACATGTGGCAGGAGGTGGGCCGCGCCATGTACGCACCGCCCATCGCCGGCAACATCACCTGCATCTCCAACATC
ACCGGCCTCCTGCTGACCCGCGACGGCGGCGAGAACACCCGGGACGGAGGCAACAACAACACGGAGACCTTCAGGCCAG
AGGGAGGCAACATGAAGGACAACTGGCGCTCCGAGCTGTACAAGTACAAGGTGGTGGAGGTGAAGCCCCTGGGCGTGGC
ACCCACCAAGGCCCGCAGGCGCGTCGTGGAGCGCGAGAAGCGCGCCGTGGGCATGGGCGCCGTGTTCCTGGGCTTCCTG
GGCGCTGCGGGCTCCACCATGGGTGCCGCGTCCATCACCCTGACCGTGCAGGCCCGCCAGCTGCTCTCCGGCATCGTGC
AGCAGCAGTCCAACCTCCTGAAGGCCATCGAGGCCCAGCAGCACATGCTGAAGCTGACCGTGTGGGGCATCAAGCAGCT
GCAGGCCAGGGTGCTCGCGCTCGAGCGCTACCTGAAGGACCAGCAGCTGCTCGGCATGTGGGGCTGCTCCGGCAAGCTG
ATCTGCACCACCAACGTGTACTGGAACTCGTCCTGGTCCAACAAGACCTACGGCGACATCTGGGACAACATGACCTGGA
TGCAGTGGGAGCGCGAGATCTCCAACTACACCGACATCATCTACGACCTCCTCGAGGAGTCCCAGAACCAGCAGGAGAA
GAACGAGCAGGATCTGCTCGCGCTGGACCGCTGGAACTCCCTGTGGAACTGGTTCAACATCACCAAGTGGCTGTGGTAC
ATCAAGATCTTCATCATGATCGTGGGCGGCCTGATCGGCCTGCGCATCATCTTCGCCGTGCTGTCGCTGGTGAACCGCG
TGCGCCAGGGCTACTCCCCGCTGTCCCTGCAAACGCTGATCCCCTCCCCCGGGGCCCGGACAGGCCCGGTGGCATCGA
GGAGGAGGGCGGCGAGCAGGACCGCAACCGCTCCACGCGCCTGGTGTCCGGCTTCCTGGCCCTGGCGTGGGACGACCTG
CGCTCCCTGTGCCTGTTCATCTACCACCGCCTGCGCGACTTCATCCTGATCGCGGCCCGCGCTGGCGAGCTGCTGGGCC
GGTCCTCGCTGAAGGGCCTGCGCCGCGGCTGGGAGGCCCTGAAGTACCTGGGCGGGCTGGTGCAGTACTGGGGCCTGGA
GCTGAAGCGCTCCGCCATCTCCCTGCTGGACACCCTGGCCATCGCCGTGGGCGAGGGCACCGACCGCATCCTGGAGTTC
GTGCTGGGCATCTGCCGCGCCATCCGCAACATCCCCACCCGCATCCGCCAGGGCTTCGAGACCGCCCTCCTGTAGTAAG
gtaaccgggacccgaattcggatcc

Figure 2C cont.

>CH505w053.31gp160 (SEQ ID NO. 134)

gtcgacaagaaATGCGCGTGATGGGCATCCAGCGCAACTACCCGCAGTGGTGGATCTGGTCGATGCTGGGCTTCTGGAT
GCTCATGATCTGCAACGGCATGTGGGTGACGGTGTACTACGGCGTGCCGGTGTGGAAGGAGGCCAAGACGACCCTGTTC
TGCGCGTCGGACGCCAAGGCCTACGAGAAGGAGGTGCACAACGTGTGGGCGACCCACGCCTGCGTGCCCACGGACCCCA
ACCCGCAGGAGATGGTGCTGAAGAACGTGACCGAGAACTTCAACATGTGGAAGAACGACATGGTGGACCAGATGCACGA
GGACGTGATCTCCCTGTGGGACCAGTCCCTGAAGCCCTGCGTGAAGCTGACCCCGCTGTGCGTGACCCTGAACTGCACC
GACGCCACCGCGTCCAACGCAACCGCGAGCAACGCCACGGCGTCGAACTCCTCCATCATCGAGGGCATGAAGAACTGCT
CCTTCAACATCACGACGGAGCTGCGCGACAAGCGCGAGAAGAAGAACGCCCTGTTCTACAAGCTGGACATCGTGCAGCT
GGACGGCAACTCCTCGCAGTACAGGCTGATCAACTGCAACACCTCCGTCATCACGCAGGCGTGCCCCAAGGTGTCCTTC
GACCCCATCCCCATCCACTACTGCGCCCCCGCCGGCTACGCCATCCTGAAGTGCAACAACAAGACCTTCAACGGCACCG
GCCCGTGCAACAACGTGTCCACCGTGCAGTGCACGCACGGGATCAAGCCCGTGGTGTCCACGCAGCTGCTCCTGAACGG
GTCGCTGGCCGAGGGCGAGATCATCATCCGGTCCGAGAACATCACGGACAACGGGAAGACCATCATCGTGCACCTGAAC
GAGTCCGTGAAGATCGAGTGCACCCGCCCGTCGAACAACACGCGCACCTCCATCCGGATCGGCCCTGGCCAGGCCTTCT
ACGCCACCGGCCAGGTGATCGGCGACATCCGCGAGGCGCACTGCAACATCTCGGAGTCCAAGTGGAACGAGACCCTGCA
GCGCGTGTCCAAGAAGCTGAAGGAGTACTTCCCCCACAAGAACATCACCTTCCAGCCGTCGTCCGGCGGCGACCTCGAG
ATCACCACGCACTCCTTCAACTGCGGTGGCGAGTTCTTCTACTGCAACACGTCGTCGCTGTTCAACCGCACCTACATGG
CCAACTCCACCGAGACCAACTCCACGCGCATCATCACGATCCGCTGCCGCATCAAGCAGATCATCAACATGTGGCAGGA
GGTGGGCCGCGCCATGTACGCACCGCCCATCGCCGGCAACATCACCTGCATCTCCAACATCACCGGCCTCCTGCTGACC
CGCGACGGCGGCAACAACAACACGGAGACCTTCAGGCCAGGCGGAGGCAACATGAAGGACAACTGGCGCTCCGAGCTGT
ACAAGTACAAGGTGGTGGAGGTGAAGCCCCTGGGCGTGGCACCCACCAACGCCCGCAGGCGCGTCGTGGAGCGCGAGAA
GCGCGCCGTGGGCATGGGCGCCGTGTTCCTGGGCTTCCTGGGCGCTGCGGGCTCCACCATGGGTGCCGCGTCCATCACC
CTGACCGTGCAGGCCCGCCAGCTGCTCTCCGGCATCGTGCAGCAGCAGTCCAACCTCCTGAAGGCCATCGGGGCCCAGC
AGCACATGCTGAAGCTGACCGTGTGGGGCATCAAGCAGCTGCAGGCCAGGGTGCTCGCGCTCGAGCGCTACCTGAAGGA
CCAGCAGCTGCTCGGCATGTGGGGCTGCTCCGGCAAGCTGATCTGCACCACCAACGTGTACTGGAACTCGTCCTGGTCC
AACAAGACCTACGGCGACATCTGGGACAACATGACCTGGATGCAGTGGGAGCGCGAGATCTCCAACTACACCGAGATGA
TCTACGAGCTCCTCGAGGAGTCCCAGAACCAGCAGGAGAAGAACGAGCAGGATCTGCTCGCGCTGGACCGCTGGAACTC
CCTGTGGAACTGGTTCAACATCACCAACTGGCTGTGGTACATCAAGATCTTCATCATGATCGTGGGCGGCCTGATCGGC
CTGCGCATCATCTTCGCCGTGCTGTCGCTGGTGAACCGCGTGCGCCAGGGCTACTCCCCGCTGTCCCTGCAAACGCTGA
TCCCCTCCCCCCGGGGCCCGGACAGGCCCGGTGGCATCGAGGAGGAGGGCGGCGAGCAGGACCGCAAGCGCTCCACGCG
CCTGGTGTCCGGCTTCCTGGCCCTGGTGTGGGACGACCTGCGCTCCCTGTGCCTGTTCATCTACCACCGCCTGCGCGAC
TTCATCCTGATCGCGGCCCGCGCTGGCGAGCTGCTGGGCCGGTCCTCGCTGAAGGGCCTGCGCCGCGGCTGGGAGGCCC
TGAAGTACCTGGGCTCGCTGGTGCAGTACTGGGGCCTGGAGCTGAAGCGCTCCGCCATCTCCCTGCTGGACACCCTGGC
CATCGCCGTGGGCGAGGGCACCGACCGCATCCTGGAGTTCGCGCTGGGCATCTGCCGCGCCATCCGCAACATCCCCACC
CGCATCCGCCAGGGCTTCGAGACCGCCCTCCTGTAGTAAGaattcggtgaccgggacctggatcc

Figure 2C cont.

>CH505.M5gp160 (SEQ ID NO. 135)

MRVMGIQRNYPQWWIWSMLGFWMLMICNGMWVTVYYGVPVWKEAKTTLFCASDAKAYEKEVHNVWATHACVPTDPNPQEM
VLKNVTENFNMWKNDMVDQMHEDVISLWDQSLKPCVKLTPLCVTLNCTNATASNSSIIEGMKNCSFNITTELRDKREKKN
ALFYKLDIVQLDGNSSQYRLINCNTSVITQACPKVSFDPIPIHYCAPAGYAILKCNNKTFTGTGPCNNVSTVQCTHGIKP
VVSTQLLLNGSLAEGEIIIRSENITKNVKTIIVHLNESVKIECTRPNNKTRTSIRIGPGQAFYATGQVIGDIREAYCNIN
ESKWNETLQRVSKKLKEYFPHKNITFQPSSGGDLEITTHSFNCGGEFFYCNTSSLFNRTYMANSTDMANSTETNSTRTIT
IHCRIKQIINMWQEVGRAMYAPPIAGNITCISNITGLLLTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLKAIEAQQHMLKLTVWGIKQLQ
ARVLALERYLKDQQLLGMWGCSGKLICTTNVYWNSSWSNKTYGDIWDNMTWMQWEREISNYTEIIYELLEESQNQQEKNE
QDLLALDRWNSLWNWFNITNWLWYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLRRGWEALKYLGSLVQYWGLELKRS
AISLLDTLAIAVGEGTDRILEFVLGICRAIRNIPTRIRQGFETALL*

>CH505.M11gp160 (SEQ ID NO. 136)

MRVMGIQRNYPQWWIWSMLGFWMLMICNGMWVTVYYGVPVWKEAKTTLFCASDAKAYEKEVHNVWATHACVPTDPNPQEM
VLKNVTENFNMWKNDMVDQMHEDVISLWDQSLKPCVKLTPLCVTLNCTNATASNSSIIEGMKNCSFNITTELRDKREKKN
ALFYKLDIVQLDGNSSQYRLINCNTSVITQACPKVSFDPIPIHYCAPAGYAILKCNNKTFTGTGPCNNVSTVQCTHGIKP
VVSTQLLLNGSLAEGEIIIRSENITDNGKTIIVHLNESVKIECTRPNNKTRTSIRIGPGQAFYATGQVIGDIREAYCNIN
ESKWNETLQRVSKKLKEYFPHKNITFQPSSGGDLEITTHSFNCGGEFFYCNTSSLFNRTYMANSTDMANSTETNSTRTIT
IHCRIKQIINMWQEVGRAMYAPPIAGNITCISNITGLLLTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLKAIEAQQHMLKLTVWGIKQLQ
ARVLALERYLKDQQLLGMWGCSGKLICTTNVYWNSSWSNKTYGDIWDNMTWMQWEREISNYTEIIYELLEESQNQQEKNE
QDLLALDRWNSLWNWFNITNWLWYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLRRGWEALKYLGSLVQYWGLELKRS
AISLLDTLAIAVGEGTDRILEFVLGICRAIRNIPTRIRQGFETALL*

Figure 2C cont.

>CH505w020.14gp160 (SEQ ID NO. 137)

MRVMGIQRNYPQWWIWSMLGFWMLMICNGMWVTVYYGVPVWKEAKTTLFCASDAKAYEKEVHNVWATHACVPTDPNPQEM
VLKNVTENFNMWKNDMVDQMHEDVISLWDQSLKPCVKLTPLCVTLNCTNATASNNSIIEGMKNCSFNITTELRDKREKKN
ALFYKLDIVQLDGNSSQYRLINCNTSVITQACPKVSFDPIPIHYCAPAGYAILKCNNKTFTGTGPCNNVSTVQCTHGIKP
VVSTQLLLNGSLAEGEIIIRSENITNNAKTIIVHLNESVKIECTRPNNKTRTSIRIGPGQAFYATGQVIGDIRKAYCNIS
ESKWNETLQRVSKKLKEYFPHKNITFQPSSGGDLEITTHSFNCGGEFFYCNTSSLFNRTYMANSTDMANSTETNSTRTIT
LHCRIKQIINMWQEVGRAMYAPPIAGNITCISNITGLLLTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLKAIEAQQHMLKLTVWGIKQLQ
ARVLALERYLKDQQLLGMWGCSGKLICTTNVYWNSSWSNKTYGDIWDNMTWMQWEREISNYTEIIYELLEESQNQQEKNE
QDLLALDRWNSLWNWFNITNWLWYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLRRGWEALKYLGSLVQYWGLELKRS
AISLLDTLAIAVGEGTDRILEFVLGICRAIRNIPTRIRQGFETALL*

>CH505w030.28gp160 (SEQ ID NO. 138)

MRVMGIQRNYPQWWIWSMLGFWMLMICNGMWVTVYYGVPVWKEAKTTLFCASDAKAYEKEVHNVWATHACVPTDPNPQEM
VLKNVTENFNMWKNDMVDQMHEDVISLWDQSLKPCVKMTPLCVTLNCTNATAINSSIIEGMKNCSFNITTELRDKREKKN
ALFYKLDIVQLDGNSSQYRLINCNTSVITQACPKVSFDPIPIHYCAPAGYAILKCNNKTFTGTGPCNNVSTVQCTHGIKP
VVSTQLLLNGSLAEGEIIIRSENITNNDKTIIVHLNESVKIECTRPNNKTRTSIRIGPGQAFYATGQVIGDIREAHCNIS
ESKWNETLQRVSKKLKEYFPHKNITFQPSSGGDLEITTHSFNCGGEFFYCNTSSLFNRTYMANSTDMANSTETNSTRTIT
IRCRIKQIINMWQEVGRAMYAPPIAGNITCISNITGLLLTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLKAIEAQQHMLKLTVWGIKQLQ
ARVLALERYLKDQQLLGMWGCSGKLICTTNVYWNSSWSNKSYGDIWDNMTWMQWEREISNYTEIIYELLEESQNQQEKNE
QDLLALDRWNSLWNWFNITNWLWYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLRRGWEALKYLGSLVQYWGLELKRS
AISLLDTLAIAVGEGTDRILEFVLGICRAIRNIPTRIRQGFETALL*

Figure 2C cont.

>CH505w078.15gp160 (SEQ ID NO. 139)

MRVMGIQRNYPQWWIWSMLGFWMLMICNGMWVTVYYGVPVWKEAKTTLFCASDAKAYEKEVHNVWATHACVPTDPNPQEM
VLKNVTENFNMWKNDMVDQMHEDVISLWDQSLKPCVKLTPLCVTLSCTNATNATASNSSILEGMKNCSFNITTELRDKRE
KKNALFYKLDIVQLDGNSSQYRLINCNTSVITQACPKVSFDPIPIHYCAPAGYAILKCNNKTFNGTGPCNNVSTVQCTHG
IKPVVSTQLLLNGSLAEGEIIIRSKNITDNGKTIIVHLNESVKIECTRPSNNTRTSIRIGPGQAFYATGQVIGDIREAHC
NISESKWNETLQRVSEKLKEYFPHKNITFQPSSGGDLEITTHSFNCGGEFFYCNTSSLFNRTYMATSTDMANSTETNSTR
IITIRCRIKQIINMWQEVGRAMYAPPIAGNITCISNITGLLLTRDGGKNDTDTFRPEGGNMKDNWRSELYKYKVVEVKPL
GVAPTNARRRVVEREKRAVGMGAVFLGFLGAAGSTMGAASITLTVQARQLLSGIVQQQSNLLKAIEAQQHMLKLTVWGIK
QLQARVLALERYLKDQQLLGMWGCSGKLICTTNVYWNSSWSNKTYGDIWDNMTWMQWEREISNYTELIYELLEESQNQQE
KNEQDLLALDRWNSLWNWFNITNWLWYIKIFIMIVGGLIGLRIIFAVLSLVNRVRQGYSPLSLQTLIPSPRGPDRPGGIE
EEGGEQDRNRSTRLVSGFLALAWDDLRSLCLFIYHRLRDFILIAARAGELLGRSSLKGLRRGWEALKYLGNLVQYWGLEL
KRSAISLLDTLAIAVGEGTDRILEFVLGICRAIRNIPTRIRQGFETALL*

>CH505w053.16gp160 (SEQ ID NO. 140)

MRVMGIQRNYPQWWIWSMLGFWMLMICNGMWVTVYYGVPVWKEAKTTLFCASDAKAYEKEVHNVWATHACVPTDPNPQEM
VLKNVTENFNMWKNDMVDQMHEDVISLWDQSLKPCVKLTPLCVTLNCTNANATASNSSIIEGMNSSIIEGMKNCSFNITT
ELRDKREKKNALFYKLDIVQLDGNSSQYRLINCNTSVITQACPKVSFDPIPIHYCAPAGYAILKCNNKTFNGTGPCNNVS
TVQCTHGIKPVVSTQLLLNGSLAEGEIIIRSENITDNGKTIIVHLNESVKIECTRPSNNTRTSIRIGPGQAFYATGQVIG
DIREAHCNISESKWNETLQRVSEKLKEYFPHKNITFQPSSGGDLEITTHSFNCGGEFFYCNTSSLFNRTYMATSTDMANS
TETNSTRIITIRCRIKQIINMWQEVGRAMYAPPIAGNITCISNITGLLLTRDGGKNNTETFETFRPGGGNMKDNWRSELY
KYKVVEVKPLGVAPTNARRRVVEREKRAVGMGAVFLGFLGAAGSTMGAASITLTVQARQLLSGIVQQQSNLLKAIEAQQH
MLKLTVWGIKQLQARVLALERYLKDQQLLGMWGCSGKLICTTNVYWNSSWSNKTYGDIWDNMTWMQWEREISNYTEIIYE
LLEESQNQQEKNEQDLLALDRWNSLWNWFNITNWLWYIKIFIMIVGGLIGLRIIFAVLSLVNRVRQGYSPLSLQTLIPSP
RGPDRPGGIEEEGGEQDRNRSTRLVSGFLALAWDDLRSLCLFIYHRLRDFILIAARAGELLGRSSLKGLRRGWEALKYLG
SLVQYWGLELKRSAISLLDTLAIAVGEGTDRILEFVLGICRAIRNIPTRIRQGFETALL*

Figure 2C cont.

>CH505w030.21gp160 (SEQ ID NO. 141)

MRVMGIQRNYPQWWIWSMLGFWMLMICNGMWVTVYYGVPVWKEAKTTLFCASDAKAYEKEVHNVWATHACVPTDPNPQEM
VLKNVTENFNMWKNDMVDQMHEDVISLWDQSLKPCVKLTPLCVTLNCTNATTNATASNSSIIEEMKNCSFNITTELRDKR
EKKNALFYKLDIVQLDGNSSQYRLINCNTSVITQACPKVSFDPIPIHYCAPAGYAILKCNNKTFTGTGPCNNVSTVQCTH
GIKPVVSTQLLLNGSLAEGEIIIRSENITNTAKTIIVHLNESVKIECTRPNNKTRTSIRIGPGQAFYATGQVIGDIREAY
CNISESKWNETLQRVSKKLKEYFPHKNITFQPSSGGDLEITTHSFNCGGEFFYCNTSSLFNRTYMANSTDMANSTETNST
RTITIRCRIKQIINMWQEVGRAMYAPPIAGNITCISNITGLLLTRDGGENNTETFRPGGGNMKDNWRSELYKYKVVEVKP
LGVAPTNARRRVVEREKRAVGMGAVFLGFLGAAGSTMGAASITLTVQARQLLSGIVQQQSNLLKAIEAQQHMLKLTVWGI
KQLQARVLALERYLKDQQLLGMWGCSGKLICTTNVYWNSSWSNKTYGDIWDNMTWMQWEREISNYTEIIYELLEESQNQQ
EKNEQDLLALDRWNSLWNWFNITNWLWYIKIFIMIVGGLIGLRIIFAVLSLVNRVRQGYSPLSLQTLIPSPRGPDRPGGI
EEEGGEQDRNRSTRLVSGFLALVWDDLRSLCLFIYHRLRDFILIAARAGELLGRSSLKGLRRGWEALKYLGSLVQYWGLE
LKRSAISLLDTLAIAVGEGTDRILEFVLGICRAIRNIPTRIRQGFETALL*

>CH505w078.33gp160 (SEQ ID NO. 142)

MRVTGIQRNYPQWWIWSMLGLWMLMICNGMWVTVYYGVPVWKEAKTTLFCASDAKAYEKEVHNVWATHACVPTDPNPQEM
VLKNVTENFNMWKNDMADQMHEDVISLWDQSLKPCVKLTPLCVTLNCIDANATASNATASNSSIIEGMKNCSFNITTELR
DKIEKKNALFYKLDIVQLDGNSSQYRLINCNTSVITQACPKVSFDPIPIHYCAPAGYAILKCNNKTFNGTGPCNNVSTVQ
CTHGIKPVVSTQLLLNGSLAEGEIIIRSENITNSAKTIIVHLNESVKIECTRPSNNTRTSIRIGPGQAFYATGQVIGDIR
KAHCNISESKWNETLQRVSKKLKEYFPHKNITFQPSSGGDLEITTHSFNCGGEFFYCNTSSLFNRTYMANSTETNSTRTI
TLHCRIKQIINMWQEVGRAMYAPPIAGNITCISNITGLLLTRDGGNNNTTETFRPGGGNMKDNWRSELYKYKVVEIKPLG
VAPTNARRRVVEREKRAVGMGAVFLGFLGAAGSTMGAASITLTVQARQLLSGIVQQQSNLLKAIEAQQHMLKLTVWGIKQ
LQARVLALERYLKDQQLLGMWGCSGKLICTTNVYWNSSWSNKTYGDIWDNMTWMQWEREISDYTEIIYELLEESQNQQEK
NEQDLLALDRWNSLWNWFNITNWLWYIKIFIMIVGGLIGLRIIFAVLSLVNRVRQGYSPLSLQTLTPSPRGPDRPGGIEE
EGGEQDRNRSTRLVSGFLALAWDDLRSLCLFIYHRLRDFILIAARAGELLGRSSLKGLRRGWEALKYLGGLVQYWGLELK
RSAISLLDTLAIAVGEGTDRILEFVLGICRAIRNIPTRIRQGFETALL*

Figure 2C cont.

>CH505w100.B6gp160 (SEQ ID NO. 143)

MKVRGIQRNYPQWWIWSMLGLWMLMICNGMWVTVYYGVPVWKEAKTTLFCASDAKAYEKEVHNVWATHACVPTDPNPQEM
VLENVTENFNMWKNDMADQMHEDVISLWDQSLKPCVKLTPLCVTLNCTDANATASNTNATASNINATASKSSIIEEMKNC
SFNITTELRDKREKKYALFYKLDIVQLDGNSSQYRLINCNTSVITQACPKVSFDPIPIHYCAPAGYAILKCNNKTFNGTG
PCNNVSTVQCTHGIKPVVSTQLLLNGSLAEGEIIIRSENITDNSKTIIVHLNESVKIECTRPSNNTRTSIRIGPGQAFYA
TGQVIGDIREAHCNISESKWNETLQRVSKKLKEYFPDKNITFQPSSGGDPEITTHSFNCGGEFFYCNTSSLFNKTYMANS
TETNSTRTITLHCRIKQIINMWQEVGRAMYAPPIAGNITCISNITGLLLTRDGGENTRDGGNNNTETFRPEGGNMKDNWR
SELYKYKVVEVKPLGVAPTKARRRVVEREKRAVGMGAVFLGFLGAAGSTMGAASITLTVQARQLLSGIVQQQSNLLKAIE
AQQHMLKLTVWGIKQLQARVLALERYLKDQQLLGMWGCSGKLICTTNVYWNSSWSNKTYGDIWDNMTWMQWEREISNYTD
IIYDLLEESQNQQEKNEQDLLALDRWNSLWNWFNITKWLWYIKIFIMIVGGLIGLRIIFAVLSLVNRVRQGYSPLSLQTL
IPSPRGPDRPGGIEEEGGEQDRNRSTRLVSGFLALAWDDLRSLCLFIYHRLRDFILIAARAGELLGRSSLKGLRRGWEAL
KYLGGLVQYWGLELKRSAISLLDTLAIAVGEGTDRILEFVLGICRAIRNIPTRIRQGFETALL*

>CH505w053.31gp160 (SEQ ID NO. 144)

MKVMGIQRNYPQWWIWSMLGFWMLMICNGMWVTVYYGVPVWKEAKTTLFCASDAKAYEKEVHNVWATHACVPTDPNPQEM
VLKNVTENFNMWKNDMVDQMHEDVISLWDQSLKPCVKLTPLCVTLNCTDATASNATASNATASNSSIIEGMKNCSFNITT
ELRDKREKKNALFYKLDIVQLDGNSSQYRLINCNTSVITQACPKVSFDPIPIHYCAPAGYAILKCNNKTFNGTGPCNNVS
TVQCTHGIKPVVSTQLLLNGSLAEGEIIIRSENITDNGKTIIVHLNESVKIECTRPSNNTRTSIRIGPGQAFYATGQVIG
DIREAHCNISESKWNETLQRVSKKLKEYFPHKNITFQPSSGGDLEITTHSFNCGGEFFYCNTSSLFNRTYMANSTETNST
RIITIRCRIKQIINMWQEVGRAMYAPPIAGNITCISNITGLLLTRDGGNNNTETFRPGGGNMKDNWRSELYKYKVVEVKP
LGVAPTNARRRVVEREKRAVGMGAVFLGFLGAAGSTMGAASITLTVQARQLLSGIVQQQSNLLKAIGAQQHMLKLTVWGI
KQLQARVLALERYLKDQQLLGMWGCSGKLICTTNVYWNSSWSNKTYGDIWDNMTWMQWEREISNYTEMIYELLEESQNQQ
EKNEQDLLALDRWNSLWNWFNITNWLWYIKIFIMIVGGLIGLRIIFAVLSLVNRVRQGYSPLSLQTLIPSPRGPDRPGGI
EEEGGEQDRKRSTRLVSGFLALVWDDLRSLCLFIYHRLRDFILIAARAGELLGRSSLKGLRRGWEALKYLGSLVQYWGLE
LKRSAISLLDTLAIAVGEGTDRILEFALGICRAIRNIPTRIRQGFETALL*

Figure 2C cont.

| Time point virus | | CH103 donal linage | | | | | | | | | | | | | CD4bs bnAb |
|---|---|---|---|---|---|---|---|---|---|---|---|---|---|---|---|
| | | UCA | IA8 | IA7 | IA6 | IA5 | IA4 | IA3 | IA2 | IA1 | CH103 | CH104 | CH105 | CH106 | CH131 |
| | IF | <50 | 49.37 | 14.87 | 4.04 | 12.84 | 10.94 | 0.22 | 1.50 | 2.47 | 3.12 | 1.99 | 4.90 | 2.28 | <0.023 |
| Week 4 | w4.3 | 15.12 | 2.05 | 0.71 | 0.99 | 0.13 | 0.67 | 0.85 | 0.29 | 0.16 | 0.13 | 0.29 | 0.38 | 0.16 | <0.023 |
| | w4.26 | 19.50 | 1.50 | 0.77 | 0.88 | 0.07 | 0.67 | 0.41 | 0.15 | 0.25 | 0.24 | 0.27 | 0.24 | 0.09 | <0.023 |
| | w4.27 | >50 | 12.39 | 2.32 | 2.57 | 4.68 | 2.70 | 6.70 | 1.89 | 1.17 | 1.94 | 1.44 | 2.40 | 0.53 | <0.023 |
| | w4.29 | >50 | 31.68 | 5.57 | 4.72 | 2.48 | 4.70 | 3.40 | 1.30 | 1.10 | 1.90 | 1.36 | 2.24 | 0.79 | <0.023 |
| | w4.8 | >50 | 16.75 | 4.20 | 4.11 | 3.30 | 3.24 | 6.09 | 1.29 | 0.95 | 1.89 | 1.62 | 2.92 | 1.39 | <0.023 |
| | w4.37 | >50 | 25.63 | 8.68 | 7.97 | 4.76 | 5.81 | 4.15 | 1.88 | 1.00 | 1.87 | 1.65 | 2.19 | 0.49 | <0.023 |
| | w4.51 | >50 | 34.15 | 6.83 | 5.77 | 8.62 | 6.54 | 5.45 | 1.54 | 1.38 | 2.04 | 1.59 | 2.11 | 0.58 | <0.023 |
| | w4.50 | >50 | 34.78 | 8.40 | 8.51 | 6.42 | 6.35 | 5.83 | 2.00 | 1.39 | 2.40 | 1.59 | 3.30 | 0.60 | <0.023 |
| | w4.16 | >50 | 21.28 | 8.43 | 4.33 | 7.32 | 6.95 | 6.40 | 2.78 | 1.39 | 2.83 | 2.66 | 4.33 | 1.23 | <0.023 |
| | w4.13 | >50 | 26.24 | 3.08 | 3.50 | 9.78 | 4.08 | 7.88 | 3.45 | 1.45 | 3.15 | 2.09 | 3.40 | 1.08 | <0.023 |
| | w4.14 | >50 | 47.61 | 11.92 | 9.71 | 13.78 | 11.02 | 10.82 | 3.53 | 2.14 | 4.00 | 2.34 | 5.22 | 1.32 | <0.023 |
| | w4.11 | >50 | >50 | 14.35 | 10.32 | 8.17 | 8.76 | 7.71 | 2.79 | 1.71 | 2.37 | 2.32 | 3.62 | 1.20 | <0.023 |
| | w4.10 | >50 | 41.38 | 8.68 | 5.32 | 5.68 | 3.80 | 3.68 | 1.17 | 0.74 | 1.10 | 1.31 | 2.44 | 0.71 | >50 |
| | w4.15 | >50 | >50 | 16.45 | 9.82 | 6.43 | 8.20 | 6.23 | 1.92 | 1.34 | 1.37 | 1.40 | 4.03 | 1.41 | 39.26 |

FIG. 9

| | | | | | | | | | | | | | | | |
|---|---|---|---|---|---|---|---|---|---|---|---|---|---|---|---|
| Week 14 | w14.21 | >50 | 24.97 | 11.01 | 6.22 | 4.07 | 3.36 | 0.94 | 0.39 | 0.24 | 0.53 | 0.37 | 0.00 | 0.41 | 0.05 |
| | w14.3 | >50 | >50 | 23.50 | 13.51 | 8.13 | 10.07 | 5.83 | 1.18 | 1.84 | 2.57 | 1.69 | 3.64 | 1.45 | <0.023 |
| | w14.19 | >50 | >50 | 16.49 | 10.14 | 20.09 | 9.20 | 6.06 | 1.82 | 1.38 | 4.66 | 2.47 | 4.39 | 2.47 | <0.023 |
| | w14.17 | >50 | >50 | 23.66 | 11.68 | 21.81 | 12.23 | 8.12 | 2.13 | 1.41 | 3.70 | 2.03 | 4.98 | 2.58 | <0.023 |
| | w14.20 | >50 | >50 | 23.58 | 12.68 | 20.30 | 15.94 | 8.27 | 1.96 | 1.07 | 2.92 | 1.68 | 3.02 | 1.43 | <0.023 |
| | w14.8 | >50 | 28.47 | 23.12 | 17.30 | 34.15 | 12.93 | 8.81 | 1.00 | 1.54 | 1.06 | 1.41 | 4.59 | 1.60 | <0.023 |
| | w14.2 | >50 | >50 | 26.68 | 14.92 | 25.33 | 13.83 | 10.30 | 2.28 | 2.87 | 4.01 | 3.24 | 6.84 | 2.88 | <0.023 |
| | w14.4 | >50 | >50 | 24.72 | 20.23 | 28.95 | 15.59 | 10.41 | 2.77 | 2.25 | 3.37 | 2.35 | 6.04 | 2.55 | <0.023 |
| | w14.6 | >50 | >50 | 28.84 | 25.13 | 32.85 | 20.88 | 12.23 | 3.37 | 3.07 | 4.14 | 3.14 | 6.99 | 3.02 | 0.03 |
| | w14.10 | >50 | >50 | 28.38 | 29.42 | 25.98 | 28.93 | 4.98 | 1.72 | 1.27 | 1.80 | 1.90 | 2.82 | 0.98 | 0.24 |
| | w14.16 | >50 | >50 | 42.21 | 27.23 | 32.29 | 18.85 | 11.75 | 4.30 | 4.08 | 6.27 | 4.48 | 8.42 | 4.46 | 0.04 |
| | w14.30 | >50 | >50 | >50 | 46.59 | 39.45 | 34.48 | 15.52 | 4.94 | 3.01 | 6.17 | 4.20 | 8.11 | 3.41 | 0.04 |
| | w14.31 | >50 | >50 | 38.38 | 25.99 | 31.67 | 28.03 | 13.04 | 4.05 | 4.28 | 5.84 | 3.69 | 7.22 | 3.19 | 0.03 |
| | w14.32 | >50 | >50 | 41.85 | 25.02 | 21.56 | 22.67 | 16.00 | 5.88 | 3.68 | 6.51 | 3.98 | 8.26 | 4.41 | <0.023 |
| | w14.38 | >50 | 43.27 | 40.88 | 24.91 | 34.07 | 32.67 | 15.15 | 5.77 | 3.09 | 5.44 | 4.73 | 8.48 | 4.52 | 0.03 |
| | w14.29 | >50 | >50 | 37.65 | 39.45 | >50 | 22.38 | 14.88 | 5.66 | 4.02 | 8.91 | 6.14 | 12.64 | 8.33 | 0.04 |
| | w14.34 | >50 | >50 | >50 | 43.94 | 48.04 | 49.79 | 22.64 | 7.05 | 5.09 | 7.32 | 5.72 | 11.24 | 4.88 | 0.06 |
| | w14.12 | >50 | >50 | >50 | >50 | >50 | >50 | >50 | >50 | >50 | 6.03 | >50 | >50 | >50 | <0.023 |

FIG. 9 Cont.

| | | | | | | | | | | | | | | | |
|---|---|---|---|---|---|---|---|---|---|---|---|---|---|---|---|
| Week 20 | w20.14 | >50 | 42.47 | 10.13 | 5.45 | 6.33 | 4.88 | 1.99 | 1.22 | 0.72 | 0.08 | 0.87 | 1.04 | 0.48 | <0.023 |
| | w20.7 | >50 | 23.68 | 8.85 | 2.05 | 2.92 | 3.83 | 1.39 | 0.82 | 0.41 | 0.52 | 0.95 | 0.86 | 0.60 | <0.04 |
| | w20.9 | >50 | 14.87 | 5.46 | 2.07 | 4.30 | 3.08 | 3.62 | 1.16 | 1.08 | 1.37 | 1.33 | 1.92 | 1.13 | <0.023 |
| | w20.23 | >50 | 26.79 | 8.07 | 4.74 | 10.60 | 3.45 | 2.65 | 1.12 | 0.64 | 0.87 | 0.87 | 1.48 | 0.88 | <0.023 |
| | w20.24 | >50 | 28.92 | 9.44 | 5.57 | 12.97 | 4.73 | 2.51 | 1.12 | 0.57 | 1.11 | 1.52 | 3.15 | 1.54 | <0.023 |
| | w20.26 | >50 | 48.25 | 10.45 | 7.31 | 8.65 | 6.79 | 2.06 | 0.90 | 0.51 | 0.88 | 1.29 | 1.23 | 0.77 | <0.05 |
| | w20.11 | >50 | 32.68 | 21.45 | 13.04 | 4.41 | 12.53 | 5.97 | 1.11 | 1.17 | 0.43 | 0.85 | 1.82 | 0.81 | <0.023 |
| | w20.22 | >50 | >50 | 20.77 | 12.38 | 14.10 | 8.22 | 3.48 | 1.26 | 0.53 | 1.45 | 0.88 | 2.21 | 1.01 | <0.023 |
| | w20.0 | >50 | >50 | 14.67 | 8.41 | 3.78 | 7.53 | 3.34 | 1.37 | 1.14 | 2.02 | 1.63 | 3.54 | 1.70 | <0.023 |
| | w20.2 | >50 | >50 | 20.17 | 18.40 | 7.08 | 19.49 | 11.80 | 4.08 | 2.12 | 3.50 | 3.29 | 6.20 | 2.78 | <0.023 |
| | w20.27 | >50 | >50 | 20.82 | 14.21 | 25.37 | 9.51 | 5.70 | 2.24 | 1.20 | 1.81 | 1.85 | 3.89 | 1.22 | <0.023 |
| | w20.4 | >50 | >50 | 25.99 | 9.46 | 3.98 | 11.83 | 2.77 | 0.88 | 0.55 | 0.87 | 0.60 | 1.36 | 0.67 | <0.07 |
| | w20.3 | >50 | >50 | >50 | 24.06 | 4.17 | 22.41 | 4.93 | 1.63 | 0.77 | 1.41 | 1.46 | 2.35 | 1.04 | <0.023 |
| | w20.21 | >50 | >50 | >50 | 29.58 | >50 | 21.02 | 6.38 | 1.88 | 1.23 | 2.54 | 1.81 | 3.64 | 1.58 | <0.023 |
| | w20.15 | >50 | >50 | 42.09 | 21.00 | 19.46 | 29.54 | 16.25 | 6.41 | 3.12 | 6.91 | 6.90 | 11.42 | 0.16 | <0.05 |
| | w20.13 | >50 | >50 | >50 | >50 | 19.84 | 31.77 | 20.17 | 6.70 | 3.62 | 6.82 | 5.60 | 14.18 | 0.15 | <0.023 |
| | w20.19 | >50 | >50 | 43.58 | >50 | 43.43 | >50 | 21.65 | 7.58 | 5.05 | 8.34 | 8.12 | 13.42 | 7.69 | <0.023 |
| | w20.25 | >50 | >50 | >50 | >50 | 37.72 | >50 | 23.37 | 11.15 | 6.41 | 7.95 | 9.01 | 14.00 | 7.96 | <0.023 |

FIG. 9 Cont.

| | | | | | | | | | | | | | | | |
|---|---|---|---|---|---|---|---|---|---|---|---|---|---|---|---|
| Week 30 | w30.28 | >50 | 44.00 | 23.07 | 7.18 | 3.78 | 6.92 | 4.35 | 0.77 | 0.49 | 0.77 | 0.59 | 2.13 | 0.77 | >50 |
| | w30.13 | >50 | >50 | >50 | 8.43 | 2.77 | 9.04 | 5.19 | 1.00 | 1.06 | 1.43 | 0.43 | 3.85 | 1.08 | >50 |
| | w30.12 | >50 | >50 | 38.85 | 25.87 | 6.44 | 18.39 | 1.92 | 0.52 | 0.65 | 1.11 | 0.95 | 1.88 | 0.82 | >50 |
| | w30.10 | >50 | >50 | >50 | 35.00 | 6.93 | 23.97 | 8.07 | 1.11 | 1.61 | 1.58 | 1.08 | 3.88 | 1.14 | >50 |
| | w30.19 | >50 | >50 | >50 | >50 | >50 | >50 | 1.45 | 0.47 | 0.39 | 0.58 | 0.51 | 0.81 | 0.54 | >50 |
| | w30.21 | >50 | >50 | >50 | >50 | >50 | >50 | 2.35 | 0.43 | 0.62 | 1.05 | 0.53 | 1.49 | 0.58 | 42.95 |
| | w30.18 | >50 | >50 | >50 | >50 | >50 | >50 | 2.92 | 1.12 | 1.08 | 1.38 | 1.16 | 2.10 | 0.88 | <0.023 |
| | w30.32 | >50 | >50 | >50 | 33.90 | >50 | 40.93 | 2.58 | 1.08 | 0.54 | 1.03 | 1.52 | 2.89 | 1.25 | 0.31 |
| | w30.6 | >50 | >50 | >50 | >50 | >50 | >50 | 15.27 | 1.30 | 4.99 | 4.15 | 1.30 | 9.23 | 4.51 | 0.03 |
| | w30.15 | >50 | >50 | >50 | >50 | >50 | >50 | 11.44 | 3.50 | 4.80 | 3.95 | 5.79 | 7.43 | 2.80 | 0.12 |
| | w30.17 | >50 | >50 | >50 | >50 | >50 | >50 | 3.66 | 7.28 | 8.08 | 4.28 | 6.78 | 14.24 | 3.90 | 0.05 |
| | w30.24 | >50 | >50 | >50 | 39.62 | 38.33 | >50 | 19.21 | 4.81 | 8.91 | 6.07 | 7.84 | 12.52 | 7.64 | 1.20 |
| | w30.5 | >50 | >50 | >50 | >50 | >50 | >50 | 45.16 | 6.76 | 9.67 | 8.05 | 7.45 | 34.12 | 10.04 | 0.04 |
| | w30.31 | >50 | >50 | >50 | >50 | >50 | >50 | 43.08 | 11.73 | 6.71 | 8.79 | 9.79 | 27.73 | 10.00 | 0.04 |
| | w30.35 | >50 | >50 | >50 | >50 | >50 | >50 | >50 | 10.96 | 8.12 | 9.24 | 11.07 | 21.16 | 8.13 | 0.26 |
| | w30.25 | >50 | >50 | >50 | >50 | >50 | >50 | 20.19 | 11.02 | 12.90 | 11.99 | 8.59 | 12.84 | 7.70 | 0.04 |
| | w30.8 | >50 | >50 | >50 | >50 | >50 | >50 | >50 | 10.36 | 12.83 | 12.58 | 7.07 | 14.11 | 9.91 | <0.023 |
| | w30.23 | >50 | >50 | >50 | >50 | >50 | >50 | 33.12 | 18.58 | 17.21 | 9.51 | 12.81 | 23.24 | 9.39 | 0.26 |
| | w30.26 | >50 | >50 | >50 | >50 | >50 | >50 | >50 | 17.23 | 12.50 | 12.11 | 18.08 | 32.38 | 12.48 | 0.12 |
| | w30.20 | >50 | >50 | >50 | >50 | >50 | >50 | >50 | 20.42 | 31.48 | 13.20 | 28.33 | 44.19 | 17.56 | 0.04 |
| | w30.27 | >50 | >50 | >50 | >50 | >50 | >50 | >50 | 43.69 | 18.28 | 30.02 | 38.02 | >50 | 31.87 | 0.17 |
| | w30.34 | >50 | >50 | >50 | >50 | >50 | >50 | >50 | 44.85 | 49.72 | 26.37 | 47.07 | >50 | 39.83 | 0.24 |
| | w30.37 | >50 | >50 | >50 | >50 | >50 | >50 | >50 | 29.75 | 25.19 | 22.30 | >50 | >50 | 40.42 | 0.14 |
| | w30.9 | >50 | >50 | >50 | >50 | >50 | >50 | >50 | 44.49 | >50 | 49.94 | 42.98 | >50 | 19.82 | 0.26 |

FIG. 9 Cont.

| | | | | | | | | | | | | | | |
|---|---|---|---|---|---|---|---|---|---|---|---|---|---|---|
| Week 53 | w53.31 | >50 | >50 | >50 | >50 | >50 | >50 | 2.38 | 1.06 | 0.43 | 1.24 | 1.09 | 2.06 | 1.88 | >50 |
| | w53.19 | >50 | >50 | >50 | >50 | >50 | >50 | 4.58 | 2.59 | 1.91 | 3.18 | 2.66 | 2.84 | 2.55 | >50 |
| | w53.13 | >50 | >50 | >50 | >50 | >50 | >50 | 12.38 | 4.78 | 3.60 | 5.30 | 4.47 | 6.64 | 4.66 | 5.61 |
| | w53.14 | >50 | >50 | >50 | >50 | >50 | >50 | 20.93 | 6.00 | 5.76 | 8.01 | 6.46 | 15.52 | 6.28 | 9.99 |
| | w53.32 | >50 | >50 | >50 | >50 | >50 | >50 | 22.80 | 7.63 | 6.09 | 6.76 | 6.29 | 13.89 | 10.78 | >50 |
| | w53.3 | >50 | >50 | >50 | >50 | >50 | >50 | 49.31 | 10.51 | 4.42 | 8.37 | 8.82 | 27.54 | 9.46 | 7.24 |
| | w53.25 | >50 | >50 | >50 | >50 | >50 | >50 | 43.14 | 13.07 | 7.56 | 9.26 | 10.10 | 28.05 | 10.47 | 5.49 |
| | w53.16 | >50 | >50 | >50 | >50 | >50 | >50 | >50 | 10.68 | 17.37 | 12.31 | 3.44 | 21.73 | 18.39 | 48.35 |
| | w53.17 | >50 | >50 | >50 | >50 | >50 | >50 | 43.24 | 10.62 | 10.32 | 10.81 | 7.25 | 20.89 | 13.80 | 8.54 |
| | w53.15 | >50 | >50 | >50 | >50 | >50 | >50 | 31.54 | 12.11 | 8.19 | 13.82 | 12.65 | 29.48 | 17.72 | 10.80 |
| | w53.28 | >50 | >50 | >50 | >50 | >50 | >50 | 46.24 | 14.19 | 7.67 | 12.65 | 14.45 | 21.84 | 15.86 | 8.89 |
| | w53.22 | >50 | >50 | >50 | >50 | >50 | >50 | 41.20 | 15.81 | 11.58 | 12.19 | 12.31 | 28.51 | 19.36 | 15.95 |
| | w53.27 | >50 | >50 | >50 | >50 | >50 | >50 | >50 | 17.47 | 14.58 | 10.47 | 13.61 | 27.02 | 14.99 | 10.48 |
| | w53.8 | >50 | >50 | >50 | >50 | >50 | >50 | >50 | 21.53 | 16.78 | 16.01 | 17.15 | 34.75 | 20.92 | 18.82 |
| | w53.10 | >50 | >50 | >50 | >50 | >50 | >50 | >50 | 10.59 | 13.21 | 16.87 | 20.07 | 31.68 | 12.73 | 5.97 |
| | w53.29 | >50 | >50 | >50 | >50 | >50 | >50 | >50 | 21.79 | 14.58 | 21.95 | 17.38 | 42.24 | 22.52 | 8.79 |
| | w53.8 | >50 | >50 | >50 | >50 | >50 | >50 | >50 | 19.43 | 16.67 | 11.88 | 19.00 | >50 | 12.57 | 1.29 |
| | w53.9 | >50 | >50 | >50 | >50 | >50 | >50 | >50 | 31.44 | 22.70 | 28.81 | 32.21 | >50 | 34.57 | 27.83 |
| | w53.11 | >50 | >50 | >50 | >50 | >50 | >50 | >50 | 26.22 | 32.31 | 30.37 | 32.63 | >50 | 37.41 | 19.14 |

FIG. 9 Cont.

| | | | | | | | | | | | | | | | |
|---|---|---|---|---|---|---|---|---|---|---|---|---|---|---|---|
| Week 78 | w78.15 | >50 | >50 | >50 | >50 | 21.97 | 49.04 | 2.97 | 0.78 | 0.25 | 1.51 | 0.86 | 2.55 | 2.08 | >50 |
| | w78.1 | >50 | >50 | >50 | >50 | >50 | >50 | 7.08 | 1.30 | 3.31 | 2.69 | 1.88 | 4.07 | 4.63 | >50 |
| | w78.3 | >50 | >50 | >50 | >50 | >50 | >50 | 7.14 | 2.28 | 1.41 | 3.74 | 3.11 | 5.34 | 5.17 | >50 |
| | w78.10 | >50 | >50 | >50 | >50 | >50 | >50 | 15.43 | 4.42 | 3.04 | 7.08 | 6.10 | 8.67 | 5.49 | >50 |
| | w78.8 | >50 | >50 | >50 | >50 | >50 | >50 | 17.86 | 6.07 | 5.27 | 8.41 | 4.85 | 9.70 | 9.33 | >50 |
| | w78.7 | >50 | >50 | >50 | >50 | >50 | >50 | 43.42 | 2.58 | 6.67 | 8.79 | 4.40 | 18.53 | 15.23 | >50 |
| | w78.33 | >50 | >50 | >50 | >50 | >50 | >50 | >50 | 12.23 | 15.79 | 4.13 | 11.08 | 20.41 | 12.20 | >50 |
| | w78.6 | >50 | >50 | >50 | >50 | >50 | >50 | >50 | 22.34 | 20.68 | 3.60 | 23.58 | >50 | 17.31 | >50 |
| | w78.14 | >50 | >50 | >50 | >50 | >50 | >50 | 28.34 | 10.25 | 6.58 | 11.33 | 9.25 | 17.70 | 17.81 | >50 |
| | w78.17 | >50 | >50 | >50 | >50 | >50 | >50 | >50 | 16.82 | 9.58 | 15.23 | 14.51 | 30.44 | 26.32 | >50 |
| | w78.36 | >50 | >50 | >50 | >50 | >50 | >50 | 33.25 | 13.81 | 13.28 | 12.32 | 12.51 | 15.49 | 12.85 | >50 |
| | w78.25 | >50 | >50 | >50 | >50 | >50 | >50 | 30.45 | 21.40 | 29.85 | 17.72 | 22.67 | 10.50 | 15.19 | 12.69 |
| | w78.4 | >50 | >50 | >50 | >50 | >50 | >50 | >50 | 19.03 | 23.66 | 22.48 | 10.56 | 24.76 | 29.17 | >50 |
| | w78.9 | >50 | >50 | >50 | >50 | >50 | >50 | 47.83 | 13.28 | 16.17 | 17.32 | 17.02 | 15.44 | 14.00 | 10.06 |
| | w78.5 | >50 | >50 | >50 | >50 | >50 | >50 | >50 | >50 | >50 | 10.90 | >50 | >50 | >50 | 15.81 |
| | w78.16 | >50 | >50 | >50 | >50 | >50 | >50 | >50 | >50 | >50 | 12.73 | >50 | >50 | >50 | 13.78 |

FIG. 9 Cont.

| | | | | | | | | | | | | | | | |
|---|---|---|---|---|---|---|---|---|---|---|---|---|---|---|---|
| Week 100 | w100.B4 | >50 | >50 | >50 | >50 | >50 | >50 | 1.64 | 1.13 | 0.91 | 3.46 | 0.64 | 0.75 | 0.74 | >50 |
| | w100.A3 | >50 | >50 | >50 | >50 | >50 | >50 | 13.27 | 2.67 | 1.02 | 5.76 | 3.81 | 7.42 | 6.10 | >50 |
| | w100.A1 | >50 | >50 | >50 | >50 | >50 | >50 | >50 | 4.13 | 2.11 | 10.74 | 3.13 | 12.24 | 3.99 | >50 |
| | w100.B3 | >50 | >50 | >50 | >50 | >50 | >50 | >50 | 3.16 | 2.06 | 10.72 | 3.42 | 12.56 | 4.64 | >50 |
| | w100.B7 | >50 | >50 | >50 | >50 | >50 | >50 | 41.77 | 4.89 | 2.36 | 11.33 | 3.66 | 14.31 | 5.38 | >50 |
| | w100.A5 | >50 | >50 | >50 | >50 | >50 | >50 | >50 | 3.70 | 1.85 | 15.63 | 3.34 | 20.89 | 5.64 | >50 |
| | w100.B6 | >50 | >50 | >50 | >50 | >50 | >50 | >50 | 2.77 | 3.15 | 10.97 | 3.00 | 13.02 | 3.41 | >50 |
| | w100.A2 | >50 | >50 | >50 | >50 | >50 | >50 | >50 | 4.85 | 3.42 | 21.38 | 7.63 | 25.34 | 9.21 | >50 |
| | w100.A13 | >50 | >50 | >50 | >50 | >50 | >50 | >50 | 3.98 | 10.38 | 26.34 | 3.49 | 17.24 | 8.83 | 3.47 |
| | w100.A6 | >50 | >50 | >50 | >50 | >50 | >50 | 16.02 | 5.79 | 6.34 | 11.51 | 5.27 | 12.04 | 12.01 | >50 |
| | w100.A4 | >50 | >50 | >50 | >50 | >50 | >50 | >50 | 12.83 | 12.93 | 13.65 | 10.51 | 25.45 | 14.08 | >50 |
| | w100.A12 | >50 | >50 | >50 | >50 | >50 | >50 | 33.48 | 13.17 | 5.96 | 18.02 | 10.77 | 20.53 | 17.72 | >50 |
| | w100.A10 | >50 | >50 | >50 | >50 | >50 | >50 | >50 | 25.12 | 27.54 | 36.75 | 21.80 | 48.74 | 37.29 | >50 |
| | w100.B8 | >50 | >50 | >50 | >50 | >50 | >50 | >50 | >50 | >50 | 44.90 | >50 | >50 | >50 | >50 |

Values are the concentrations (μg/ml) of antibodies required for the 50% inhibition ($IC_{50}$)

FIG. 9 Cont.

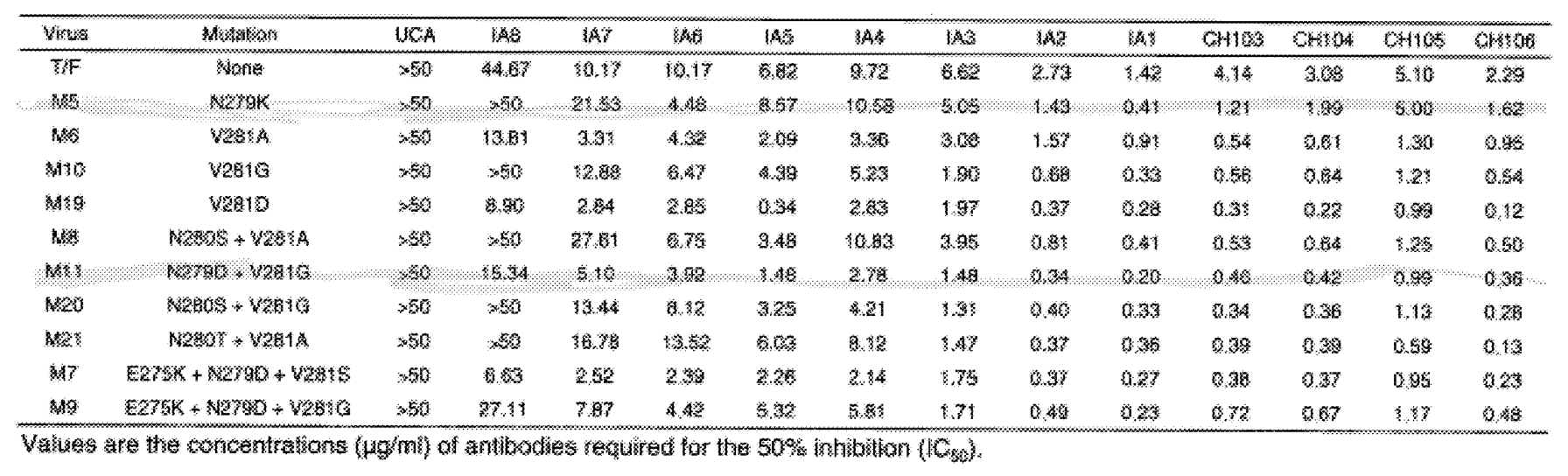

| Virus | Mutation | UCA | IA8 | IA7 | IA6 | IA5 | IA4 | IA3 | IA2 | IA1 | CH103 | CH104 | CH105 | CH106 |
|---|---|---|---|---|---|---|---|---|---|---|---|---|---|---|
| T/F | None | >50 | 44.67 | 10.17 | 10.17 | 6.82 | 9.72 | 6.62 | 2.73 | 1.42 | 4.14 | 3.08 | 5.10 | 2.29 |
| M5 | N279K | >50 | >50 | 21.53 | 4.48 | 8.57 | 10.58 | 5.05 | 1.43 | 0.41 | 1.21 | 1.99 | 5.00 | 1.62 |
| M6 | V281A | >50 | 13.61 | 3.31 | 4.32 | 2.09 | 3.36 | 3.08 | 1.57 | 0.91 | 0.54 | 0.61 | 1.30 | 0.95 |
| M10 | V281G | >50 | >50 | 12.88 | 6.47 | 4.39 | 5.23 | 1.90 | 0.68 | 0.33 | 0.56 | 0.64 | 1.21 | 0.54 |
| M19 | V281D | >50 | 8.90 | 2.84 | 2.85 | 0.34 | 2.63 | 1.97 | 0.37 | 0.28 | 0.31 | 0.22 | 0.99 | 0.12 |
| M8 | N280S + V281A | >50 | >50 | 27.61 | 6.75 | 3.48 | 10.83 | 3.95 | 0.81 | 0.41 | 0.53 | 0.64 | 1.25 | 0.50 |
| M11 | N279D + V281G | >50 | 15.34 | 5.10 | 3.92 | 1.46 | 2.78 | 1.48 | 0.34 | 0.20 | 0.46 | 0.42 | 0.99 | 0.36 |
| M20 | N280S + V281G | >50 | >50 | 13.44 | 8.12 | 3.25 | 4.21 | 1.31 | 0.40 | 0.33 | 0.34 | 0.36 | 1.13 | 0.28 |
| M21 | N280T + V281A | >50 | >50 | 16.78 | 13.52 | 6.03 | 8.12 | 1.47 | 0.37 | 0.36 | 0.39 | 0.39 | 0.59 | 0.13 |
| M7 | E275K + N279D + V281S | >50 | 6.63 | 2.52 | 2.39 | 2.26 | 2.14 | 1.75 | 0.37 | 0.27 | 0.38 | 0.37 | 0.95 | 0.23 |
| M9 | E275K + N279D + V281G | >50 | 27.11 | 7.87 | 4.42 | 5.32 | 5.81 | 1.71 | 0.49 | 0.23 | 0.72 | 0.67 | 1.17 | 0.48 |

Values are the concentrations (μg/ml) of antibodies required for the 50% inhibition ($IC_{50}$).

Figure 10

6 - Swarm

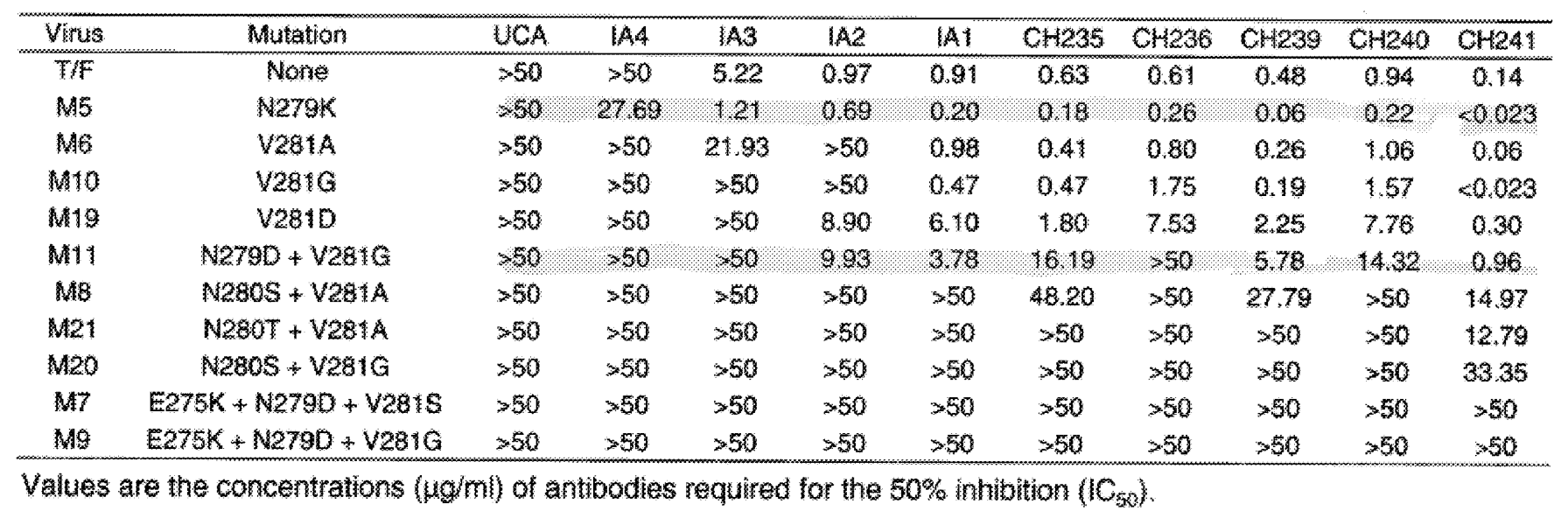

| Virus | Mutation | UCA | IA4 | IA3 | IA2 | IA1 | CH235 | CH236 | CH239 | CH240 | CH241 |
|---|---|---|---|---|---|---|---|---|---|---|---|
| T/F | None | >50 | >50 | 5.22 | 0.97 | 0.91 | 0.63 | 0.61 | 0.48 | 0.94 | 0.14 |
| M5 | N279K | >50 | 27.69 | 1.21 | 0.69 | 0.20 | 0.18 | 0.26 | 0.06 | 0.22 | <0.023 |
| M6 | V281A | >50 | >50 | 21.93 | >50 | 0.98 | 0.41 | 0.80 | 0.26 | 1.06 | 0.06 |
| M10 | V281G | >50 | >50 | >50 | >50 | 0.47 | 0.47 | 1.75 | 0.19 | 1.57 | <0.023 |
| M19 | V281D | >50 | >50 | >50 | 8.90 | 6.10 | 1.80 | 7.53 | 2.25 | 7.76 | 0.30 |
| M11 | N279D + V281G | >50 | >50 | >50 | 9.93 | 3.78 | 16.19 | >50 | 5.78 | 14.32 | 0.96 |
| M8 | N280S + V281A | >50 | >50 | >50 | >50 | >50 | 48.20 | >50 | 27.79 | >50 | 14.97 |
| M21 | N280T + V281A | >50 | >50 | >50 | >50 | >50 | >50 | >50 | >50 | >50 | 12.79 |
| M20 | N280S + V281G | >50 | >50 | >50 | >50 | >50 | >50 | >50 | >50 | >50 | 33.35 |
| M7 | E275K + N279D + V281S | >50 | >50 | >50 | >50 | >50 | >50 | >50 | >50 | >50 | >50 |
| M9 | E275K + N279D + V281G | >50 | >50 | >50 | >50 | >50 | >50 | >50 | >50 | >50 | >50 |

Values are the concentrations (μg/ml) of antibodies required for the 50% inhibition ($IC_{50}$).

Figure 12

| Time point | Virus | CH235 clonal linage | | | | | | | | | | CD4bs bnAb |
|---|---|---|---|---|---|---|---|---|---|---|---|---|
| | | UCA | IA4 | IA3 | IA2 | IA1 | CH235 | CH236 | CH239 | CH240 | CH241 | CH31 |
| | T/F | >50 | >50 | 5.22 | 0.97 | 0.91 | 0.63 | 0.61 | 0.48 | 0.94 | 0.14 | <0.023 |
| Week 4 | w4.3 | >50 | >50 | 1.65 | 0.35 | 0.30 | 0.11 | 0.40 | 0.10 | 0.25 | <0.023 | <0.023 |
| | w4.26 | >50 | >50 | 3.67 | 1.36 | 0.32 | 0.46 | 0.78 | 0.30 | 0.67 | 0.05 | <0.023 |
| | w4.10 | >50 | 20.51 | 1.02 | 0.24 | 0.20 | 0.10 | 0.10 | <0.023 | 0.15 | <0.023 | >50 |
| Week 14 | w14.21 | >50 | >50 | >50 | 38.08 | 0.79 | 0.36 | 0.96 | 0.14 | 0.58 | 0.04 | 0.13 |
| | w14.3 | >50 | >50 | 6.28 | 1.40 | 0.79 | 0.49 | 0.75 | 0.40 | 1.05 | 0.09 | <0.023 |
| | w14.4 | >50 | >50 | 3.60 | 1.00 | 0.72 | 0.27 | 0.88 | 0.40 | 0.60 | 0.08 | <0.023 |
| | w14.6 | >50 | >50 | 5.73 | 1.64 | 0.92 | 0.31 | 0.63 | 0.43 | 0.73 | 0.17 | <0.023 |
| | w14.29 | >50 | >50 | 5.34 | 1.02 | 0.86 | 0.75 | 1.05 | 0.61 | 0.88 | 0.17 | 0.02 |
| | w14.34 | >50 | >50 | 4.84 | 0.94 | 0.84 | 0.52 | 1.09 | 0.78 | 0.89 | 0.12 | <0.023 |
| | w14.12 | >50 | >50 | 34.99 | 2.22 | 0.85 | 0.42 | 0.53 | 0.41 | 0.93 | 0.09 | <0.023 |
| Week 20 | w20.14 | >50 | >50 | 10.80 | 1.99 | 0.91 | 0.63 | 0.61 | 0.48 | 0.96 | 0.09 | <0.023 |
| | w20.7 | >50 | >50 | >50 | 31.29 | 0.85 | 0.43 | 1.30 | 0.28 | 0.85 | 0.06 | 0.14 |
| | w20.27 | >50 | >50 | 10.28 | 2.06 | 0.98 | 0.39 | 0.46 | 0.27 | 1.13 | 0.10 | <0.023 |
| | w20.4 | >50 | >50 | >50 | 47.61 | 0.94 | 0.65 | 1.81 | 0.18 | 1.00 | 0.06 | 0.12 |
| | w20.19 | >50 | >50 | 8.99 | 2.12 | 1.99 | 1.16 | 1.24 | 1.11 | 1.63 | 0.27 | 0.02 |
| | w20.25 | >50 | >50 | 8.54 | 1.69 | 1.65 | 1.08 | 0.85 | 0.75 | 1.41 | 0.18 | <0.023 |
| Week 30 | w30.28 | >50 | >50 | >50 | >50 | 5.28 | 2.16 | 9.14 | 2.07 | 5.28 | 0.40 | >50 |
| | w30.13 | >50 | >50 | >50 | >50 | 4.73 | 1.15 | 4.39 | 1.49 | 5.11 | 2.96 | >50 |
| | w30.24 | >50 | >50 | 29.77 | 27.95 | 4.62 | 2.06 | 3.69 | 1.54 | 4.12 | 0.49 | 0.35 |
| | w30.5 | >50 | >50 | >50 | 7.72 | 1.83 | 0.80 | 0.58 | 0.67 | 2.08 | 1.17 | 0.04 |
| | w30.34 | >50 | >50 | >50 | 4.98 | 5.18 | 3.23 | 2.27 | 3.02 | 5.61 | 3.68 | 0.15 |
| | w30.37 | >50 | >50 | >50 | 6.45 | 6.92 | 4.25 | 2.60 | 2.79 | 7.57 | 3.99 | 0.17 |

Figure 13

| | | | | | | | | | | | | |
|---|---|---|---|---|---|---|---|---|---|---|---|---|
| Wek 53 | w53.31 | >50 | >50 | >50 | >50 | >50 | >50 | >50 | >50 | >50 | >50 | >50 |
| | w53.13 | >50 | >50 | >50 | >50 | >50 | >50 | >50 | 33.78 | >50 | >50 | 11.58 |
| | w53.28 | >50 | >50 | >50 | >50 | >50 | >50 | >50 | >50 | >50 | >50 | 12.64 |
| | w53.22 | >50 | >50 | >50 | >50 | >50 | >50 | >50 | >50 | >50 | >50 | 34.28 |
| | w53.6 | >50 | >50 | >50 | >50 | >50 | >50 | >50 | 19.95 | >50 | >50 | 0.93 |
| | w53.11 | >50 | >50 | >50 | >50 | >50 | >50 | >50 | >50 | >50 | >50 | 21.96 |
| Week 78 | w78.15 | >50 | >50 | >50 | >50 | >50 | 46.43 | >50 | >50 | >50 | >50 | 22.63 |
| | w78.1 | >50 | >50 | >50 | >50 | >50 | >50 | >50 | >50 | >50 | >50 | >50 |
| | w78.33 | >50 | >50 | >50 | >50 | >50 | >50 | >50 | >50 | >50 | 33.95 | 32.10 |
| | w78.6 | >50 | >50 | >50 | >50 | >50 | >50 | >50 | >50 | >50 | >50 | >50 |
| | w78.9 | >50 | >50 | >50 | >50 | >50 | >50 | >50 | >50 | >50 | >50 | 35.39 |
| | w78.5 | >50 | >50 | >50 | >50 | >50 | >50 | >50 | >50 | >50 | >50 | 20.20 |
| Week 100 | w100.B4 | >50 | >50 | >50 | >50 | >50 | >50 | >50 | >50 | >50 | >50 | 49.40 |
| | w100.A3 | >50 | >50 | >50 | >50 | >50 | >50 | >50 | >50 | >50 | 45.37 | 45.65 |
| | w100.A5 | >50 | >50 | >50 | >50 | >50 | >50 | >50 | >50 | >50 | >50 | 46.55 |
| | w100.B6 | >50 | >50 | >50 | >50 | >50 | >50 | >50 | >50 | >50 | >50 | >50 |
| | w100.A10 | >50 | >50 | >50 | >50 | >50 | >50 | >50 | 48.62 | >50 | 41.17 | >50 |
| | w100.B8 | >50 | >50 | >50 | >50 | >50 | >50 | >50 | >50 | >50 | >50 | >50 |

Values are the concentrations (μg/ml) of antibodies required for the 50% inhibition ($IC_{50}$).

Figure 13 cont.

CH235 Lineage

| | UCA | IA4 | IA3 | IA2 | IA1 | CH240 | CH236 | CH235 | CH239 | CH241 | CH491 | CH493 | CH558 | CH557 |
|---|---|---|---|---|---|---|---|---|---|---|---|---|---|---|
| **CH505.M5 gp120** | 0.2 | 1.4 | 7 | 6.9 | 9.2 | 7.4 | 7.3 | 11 | 13 | 15 | 11 | 9.3 | 6.5 | 8.2 |
| **CH505.M11 gp120** | nb | nb | nb | nb | 2.8 | 0.5 | 1.4 | 7.6 | 1.4 | 9.7 | 6.8 | 8.3 | 5.4 | 7.7 |
| **CH505w20.14 gp120** | nb | nb | 2.7 | 1.2 | 6.5 | 3.8 | 6.7 | 9.9 | 9 | 13 | 9.3 | 8.2 | 6.1 | 8.3 |
| **CH505w30.20 gp120** | nb | 0.2 | 1.2 | 0.5 | 4.8 | 1.5 | 6.2 | 8.3 | 8 | 8 | 8.8 | 8.1 | 5.4 | 8.8 |
| **CH505w30.12 gp120** | nb | nb | nb | nb | 2.4 | 0.4 | 1 | 7.3 | 3.4 | 9.6 | 3.9 | 3.2 | 1 | 2.4 |
| **CH505w136.B18 gp120** | nb | nb | nb | nb | 2.4 | 0.3 | 3.5 | 7.5 | 0.7 | 0.9 | 3.5 | 5.8 | 1.8 | 8.3 |

Figure 16A

CH103 Lineage

| UCA | IA8 | IA7 | IA6 | IA4 | CH186 | CH187 | CH188 | CH200 | 1AH92U | IA3 | CH105 | IA2 | CH104 | IA1 | CH106 | CH103 | CH243 | CH244 | CH245 | CH247 | CH248 |
|---|---|---|---|---|---|---|---|---|---|---|---|---|---|---|---|---|---|---|---|---|---|
| nb | 0.6 | 2.3 | 3.3 | 3.8 | 12 | 9.4 | 9 | 8.9 | 6.1 | 6.9 | 8.6 | 7.8 | 9 | 7 | 8.4 | 9.8 | 10 | 10 | 11 | 11 | 11 |
| 2.6 | 6.2 | 10 | 10 | 10 | 14 | 13 | 13 | 11 | 12 | 12 | 12 | 13 | 12 | 12 | 13 | 13 | 14 | 14 | 14 | 14 | 14 |
| 0.3 | 3.4 | 7.2 | 7.9 | 8.6 | 13 | 11 | 11 | 8.7 | 10 | 11 | 10 | 11 | 10 | 10 | 11 | 13 | 13 | 12 | 12 | 12 | 12 |
| nb | nb | nb | nb | nb | 8.6 | 1.2 | 1.2 | 2.8 | 4.9 | 4.8 | 7.1 | 6.3 | 7.5 | 5.7 | 7.3 | 9.5 | 9 | 10 | 9.9 | 12 | 10 |
| nb | 0.4 | 1 | 1.2 | 1.9 | 12 | 12 | 12 | 7.3 | 9.4 | 7.6 | 11 | 12 | 12 | 11 | 12 | 13 | 14 | 14 | 14 | 14 | 13 |
| nb | nb | nb | nb | nb | nb | nb | nb | nb | 8.7 | 14 | 14 | 14 | 14 | 14 | 13 | 12 | 14 | 15 | 15 | 13 | 14 |

Figure 16B

| gp120 | Plasmid ID |
|---|---|
| CH505.M5D8gp120 | HV1300531_v2 |
| CH505.M11D8gp120 | HV1300537_v2 |
| CH505w020.14D8gp120 | HV1300556_v2 |
| CH505w030.20D8gp120 | HV1300573_v2 |
| CH505.w30.12D8gp120 | HV1300778 |
| CH505w136.B8D8gp120 | HV1300612 |

Coding sequence is in capital letters

>HV1300531_v2, CH505.M5D8gp120 (SEQ ID NO. 145)
gtgtcgacaagaagccaccATGCGCGTGATGGGCATCCAGCGCAACTACCCGCAGTGGTGGATCTGGTCGATGCTGGGC
TTCTGGATGCTCATGATCTGCAACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGT
GCTGAAGAACGTGACCGAGAACTTCAACATGTGGAAGAACGACATGGTGGACCAGATGCACGAGGACGTGATCTCCCTG
TGGGACCAGTCCCTGAAGCCCTGCGTGAAGCTGACCCCGCTGTGCGTGACCCTGAACTGCACCAACGCCACCGCGTCCA
ACTCCTCCATCATCGAGGGCATGAAGAACTGCTCCTTCAACATCACGACGGAGCTGCGCGACAAGCGCGAGAAGAAGAA
CGCCCTGTTCTACAAGCTGGACATCGTGCAGCTGGACGGCAACTCCTCGCAGTACAGGCTGATCAACTGCAACACCTCC
GTCATCACGCAGGCGTGCCCCAAGGTGTCCTTCGACCCCATCCCCATCCACTACTGCGCCCCCGCCGGCTACGCCATCC
TGAAGTGCAACAACAAGACCTTCACCGGCACCGGCCCGTGCAACAACGTGTCCACCGTGCAGTGCACGCACGGGATCAA
GCCCGTGGTGTCCACGCAGCTGCTCCTGAACGGGTCGCTGGCCGAGGGCGAGATCATCATCCGGTCCGAGAACATCACG
AAGAACGTGAAGACCATCATCGTGCACCTGAACGAGTCCGTGAAGATCGAGTGCACCCGCCCGAACAACAAGACGCGCA
CCTCCATCCGGATCGGCCCTGGCCAGGCCTTCTACGCCACCGGCCAGGTGATCGGCGACATCCGCGAGGCGTACTGCAA
CATCAACGAGTCCAAGTGGAACGAGACCCTGCAGCGCGTGTCCAAGAAGCTGAAGGAGTACTTCCCCCACAAGAACATC
ACCTTCCAGCCGTCGTCCGGCGGCGACCTCGAGATCACCACGCACTCCTTCAACTGCGGTGGCGAGTTCTTCTACTGCA
ACACGTCGTCGCTGTTCAACCGCACCTACATGGCCAACTCCACCGACATGGCCAACTCCACCGAGACCAACTCCACGCG
CACCATCACGATCCACTGCCGCATCAAGCAGATCATCAACATGTGGCAGGAGGTGGGCCGCGCCATGTACGCACCGCCC
ATCGCCGGCAACATCACCTGCATCTCCAACATCACCGGCCTCCTGCTGACCCGCGACGGCGGCAAGAACAACACGGAGA
CCTTCAGGCCAGGCGGAGGCAACATGAAGGACAACTGGCGCTCCGAGCTGTACAAGTACAAGGTGGTGGAGGTGAAGCC
CCTGGGCGTGGCACCCACCAACGCCCGCGAGCGCGTCGTGGAGCGCGAGAAGGAGTAGTAAGgtgaccgaattcgggac
ccggatcc

Figure 17A

>HV1300537_v2, CH505.M11D8gp120 (SEQ ID NO. 146)

gtgtcgacaagaagccaccATGCGCGTGATGGGCATCCAGCGCAACTACCCGCAGTGGTGGATCTGGTCGATGCTGGGC
TTCTGGATGCTCATGATCTGCAACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGT
GCTGAAGAACGTGACCGAGAACTTCAACATGTGGAAGAACGACATGGTGGACCAGATGCACGAGGACGTGATCTCCCTG
TGGGACCAGTCCCTGAAGCCCTGCGTGAAGCTGACCCCGCTGTGCGTGACCCTGAACTGCACCAACGCCACCGCGTCCA
ACTCCTCCATCATCGAGGGCATGAAGAACTGCTCCTTCAACATCACGACGGAGCTGCGCGACAAGCGCGAGAAGAAGAA
CGCCCTGTTCTACAAGCTGGACATCGTGCAGCTGGACGGCAACTCCTCGCAGTACAGGCTGATCAACTGCAACACCTCC
GTCATCACGCAGGCGTGCCCCAAGGTGTCCTTCGACCCCATCCCCATCCACTACTGCGCCCCCGCCGGCTACGCCATCC
TGAAGTGCAACAACAAGACCTTCACCGGCACCGGCCCGTGCAACAACGTGTCCACCGTGCAGTGCACGCACGGGATCAA
GCCCGTGGTGTCCACGCAGCTGCTCCTGAACGGGTCGCTGGCCGAGGGCGAGATCATCATCCGGTCCGAGAACATCACG
GACAACGGGAAGACCATCATCGTGCACCTGAACGAGTCCGTGAAGATCGAGTGCACCCGCCCGAACAACAAGACGCGCA
CCTCCATCCGGATCGGCCCTGGCCAGGCCTTCTACGCCACCGGCCAGGTGATCGGCGACATCCGCGAGGCGTACTGCAA
CATCAACGAGTCCAAGTGGAACGAGACCCTGCAGCGCGTGTCCAAGAAGCTGAAGGAGTACTTCCCCCACAAGAACATC
ACCTTCCAGCCGTCGTCCGGCGGCGACCTCGAGATCACCACGCACTCCTTCAACTGCGGTGGCGAGTTCTTCTACTGCA
ACACGTCGTCGCTGTTCAACCGCACCTACATGGCCAACTCCACCGACATGGCCAACTCCACCGAGACCAACTCCACGCG
CACCATCACGATCCACTGCCGCATCAAGCAGATCATCAACATGTGGCAGGAGGTGGGCCGCGCCATGTACGCACCGCCC
ATCGCCGGCAACATCACCTGCATCTCCAACATCACCGGCCTCCTGCTGACCCGCGACGGCGGCAAGAACAACACGGAGA
CCTTCAGGCCAGGCGGAGGCAACATGAAGGACAACTGGCGCTCCGAGCTGTACAAGTACAAGGTGGTGGAGGTGAAGCC
CCTGGGCGTGGCACCCACCAACGCCCGCGAGCGCGTCGTGGAGCGCGAGAAGGAGTAGTAAGgtgaccgaattcaggtc
ccggatcc

Figure 17A cont.

>HV1300556_v2, CH505w020.14D8gp120(SEQ ID NO. 147)

gtgtcgacaagaagccaccATGCGCGTGATGGGCATCCAGCGCAACTACCCGCAGTGGTGGATCTGGTCGATGCTGGGC
TTCTGGATGCTCATGATCTGCAACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGT
GCTGAAGAACGTGACCGAGAACTTCAACATGTGGAAGAACGACATGGTGGACCAGATGCACGAGGACGTGATCTCCCTG
TGGGACCAGTCCCTGAAGCCCTGCGTGAAGCTGACCCCGCTGTGCGTGACCCTGAACTGCACCAACGCCACCGCGTCCA
ACAACTCCATCATCGAGGGCATGAAGAACTGCTCCTTCAACATCACGACGGAGCTGCGCGACAAGCGCGAGAAGAAGAA
CGCCCTGTTCTACAAGCTGGACATCGTGCAGCTGGACGGCAACTCCTCGCAGTACAGGCTGATCAACTGCAACACCTCC
GTCATCACGCAGGCGTGCCCCAAGGTGTCCTTCGACCCCATCCCCATCCACTACTGCGCCCCCGCCGGCTACGCCATCC
TGAAGTGCAACAACAAGACCTTCACCGGCACCGGCCCGTGCAACAACGTGTCCACCGTGCAGTGCACGCACGGGATCAA
GCCCGTGGTGTCCACGCAGCTGCTCCTGAACGGGTCGCTGGCCGAGGGCGAGATCATCATCCGGTCCGAGAACATCACG
AACAACGCGAAGACCATCATCGTGCACCTGAACGAGTCCGTGAAGATCGAGTGCACCCGCCCGAACAACAAGACGCGCA
CGTCCATCCGGATCGGCCCTGGCCAGGCCTTCTACGCCACCGGCCAGGTGATCGGCGACATCCGCAAGGCGTACTGCAA
CATCTCGGAGTCCAAGTGGAACGAGACCCTGCAGCGCGTGTCCAAGAAGCTGAAGGAGTACTTCCCCCACAAGAACATC
ACCTTCCAGCCGTCGTCCGGCGGCGACCTCGAGATCACCACGCACTCCTTCAACTGCGGTGGCGAGTTCTTCTACTGCA
ACACGTCGTCGCTGTTCAACCGCACCTACATGGCCAACTCCACCGACATGGCCAACTCCACCGAGACCAACTCCACGCG
CACCATCACGCTCCACTGCCGCATCAAGCAGATCATCAACATGTGGCAGGAGGTGGGCCGCGCCATGTACGCACCGCCC
ATCGCCGGCAACATCACCTGCATCTCCAACATCACCGGCCTCCTGCTGACCCGCGACGGCGGCAAGAACAACACGGAGA
CCTTCAGGCCAGGCGGAGGCAACATGAAGGACAACTGGCGCTCCGAGCTGTACAAGTACAAGGTGGTGGAGGTGAAGCC
CCTGGGCGTGGCACCCACCAACGCCCGCGAGCGCGTCGTGGAGCGCGAGAAGGAGTAGTAAGggacccgaattcggtca
ccggatcc

Figure 17A cont.

>HV1300573_v2, CH505w030.20D8gp120 (SEQ ID NO. 148)

gtgtcgacaagaagccaccATGCGCGTGATGGGCATCCAGCGCAACTACCCGCAGTGGTGGATCTGGTCGATGCTGGGC
TTCTGGATGCTCATGATCTGCAACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGT
GCTGAAGAACGTGACCGAGAACTTCAACATGTGGAAGAACGACATGGTGGACCAGATGCACGAGGACGTGATCTCCCTG
TGGGACCAGTCCCTGAAGCCCTGCGTGAAGCTGACCCCGCTGTGCGTGACCCTGAACTGCACCAACGCGACGACCAACG
CCACCGCGTCCAACTCCTCCATCATCGAGGGCATGAAGAACTGCTCCTTCAACATCACGACGGAGCTGCGCGACAAGCG
CGAGAAGAAGAACGCCCTGTTCTACAAGCTGGACATCGTGCAGCTGGACGGCAACTCCTCGCAGTACAGGCTGATCAAC
TGCAACACCTCCGTCATCACGCAGGCGTGCCCCAAGGTGTCCTTCGACCCCATCCCCATCCACTACTGCGCCCCCGCCG
GCTACGCCATCCTGAAGTGCAACAACAAGACCTTCACCGGCACCGGCCCGTGCAACAACGTGTCCACCGTGCAGTGCAC
GCACGGGATCAAGCCCGTGGTGTCCACGCAGCTGCTCCTGAACGGGTCGCTGGCCGAGGGCGAGATCATCATCCGGTCC
GAGAACATCACGAACAACGCGAAGACCATCATCGTGCACCTGAACGAGTCCGTGAAGATCGAGTGCACCCGCCCGAACA
ACAAGACGCGCACCTCCATCCGGATCGGCCCTGGCCAGGCCTTCTACGCCACCGGCCAGGTGATCGGCGACATCCGCGA
GGCGTACTGCAACATCAGCGAGTCCAAGTGGAACGAGACCCTGCAGCGCGTGTCCAAGAAGCTGAAGGAGTACTTCCCC
CACAAGAACATCACCTTCCAGCCGTCGTCCGGCGGCGACCTCGAGATCACCACGCACTCCTTCAACTGCGGTGGCGAGT
TCTTCTACTGCAACACGTCGTCGCTGTTCAACCGCACCTACATGGCCAACTCCACCGACATGGCCAACTCCACCGAGAC
CAACTCCACGCGCATCATCACGATCCACTGCCGCATCAAGCAGATCATCAACATGTGGCAGGAGGTGGGCCGCGCCATG
TACGCACCGCCCATCGCCGGCAACATCACCTGCATCTCCAACATCACCGGCCTCCTGCTGACCCGCGACGGCGGCAAGA
ACACGAGGGACGGAGGCAAGAACAACACGGAGACCTTCAGGCCAGGCGGAGGCAACATGAAGGACAACTGGCGCTCCGA
GCTGTACAAGTACAAGGTGGTGGAGGTGAAGCCCCTGGGCGTGGCACCCACCAACGCCCGCGAGCGCGTCGTGGAGCGC
GAGAAGGAGTAGTAAGggtcctgaattcggtaaccggatcc

Figure 17A cont.

>HV1300778, CH505.w30.12D8gp120 (SEQ ID NO. 149)

gtcgacaagaagccaccATGCGCGTGATGGGCATCCAGCGCAACTACCCGCAGTGGTGGATCTGGTCGATGCTGGGCTT
CTGGATGCTCATGATCTGCAACGGCGTGCCGGTGTGGAAGGAGGCCAAGACGACCCTGTTCTGCGCGTCGGACGCCAAG
GCCTACGAGAAGGAGGTGCACAACGTGTGGGCGACCCACGCCTGCGTGCCCACGGACCCCAACCCGCAGGAGATGGTGC
TGAAGAACGTGACCGAGAACTTCAACATGTGGAAGAACGACATGGTGGACCAGATGCACGAGGACGTGATCTCCCTGTG
GGACCAGTCCCTGAAGCCCTGCGTGAAGCTGACCCCGCTGTGCGTGACCCTGAACTGCACCAACGCGACCAACGCCACC
GCGTCCAACTCCTCCATCATCGAGGGCATGAAGAACTGCTCCTTCAACATCACGACGGAGCTGCGCGACAAGCGCGAGA
AGAAGAACGCCCTGTTCTACAAGCTGGACATCGTGCAGCTGGACGGCAACTCCTCGCAGTACAGGCTGATCAACTGCAA
CACCTCCGTCATCACGCAGGCGTGCCCCAAGGTGTCCTTCGACCCCATCCCCATCCACTACTGCGCCCCCGCCGGCTAC
GCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAA
CATCACGAACAACGACAAGACCATCATCGTGCACCTGAACGAGTCCGTGAAGATCGAGTGCACCCGCCCGAGCAACAAG
ACGCGCACCTCCATCCGGATCGGCCCTGGCCAGGCCTTCTACGCCACCGGCCAGGTGATCGGCGACATCCGCGAGGCGT
ACTGCAACATCAGCGAGTCCAAGTGGAACGAGACCCTGCAGCGCGTGTCCAAGAAGCTGAAGGAGTACTTCCCCCACAA
GAACATCACCTTCCAGCCGTCGTCCGGCGGCGACCTCGAGATCACCACGCACTCCTTCAACTGCGGTGGCGAGTTCTTC
TACTGCAACACGTCGTCGCTGTTCAACCGCACCTACATGGCCAACTCCACCGACATGGCCAACTCCACCGAGACCAACT
CCACGCGCAACATCACGATCCACTGCCGCATCAAGCAGATCATCAACATGTGGCAGGAGGTGGGCCGCGCCATGTACGC
ACCGCCCATCGCCGGCAACATCACCTGCATCTCCAACATCACCGGCCTCCTGCTGACCCGCGACGGCGGCAAGAACGAC
ACGGAGACCTTCAGGCCAGGCGGAGGCAACATGAAGGACAACTGGCGCTCCGAGCTGTACAAGTACAAGGTGGTGGAGG
TGAAGCCCCTGGGCGTGGCACCCACCAACGCCcgcGAgcgcgtcgtggagcgcgagaagGAGTGATAGTAAGaggtccc
ggtaaccggatcc

Figure 17A cont.

>HV1300612, CH505w136.B8D8gp120 (SEQ ID NO. 150)

gtcgacaagaagccaccATGCGCGTGCGCGGCATCCAGCGCAGCTACCCGCAGTGGTGGATCTGGTCGATGCTGGGCTT
CTGGATGCTCATGATCTGCAACGGCGTGCCGGTGTGGAAGGAGGCCAAGACGACCCTGTTCTGCGCGTCGGACGCCAAG
GCCTACGAGAAGGAGGTGCACAACGTGTGGGCGACCCACGCCTGCGTGCCCACGGACCCCAACCCGCAGGAGATGGTGC
TGAAGAACGTGACCGAGAACTTCAACATGTGGGAGAACGACATGGTGGACCAGATGCACGAGGACGTGATCTCCCTGTG
GGACCAGTCCCTGAAGCCCTGCGTGAAGCTGACCCCGCTGTGCGTGACCCTGAACTGCATCAACGCCACCAACGCGACG
GACTCGAACTCCAACATCCTCGAGGGGATGAAGAACTGCTCCTTCAACATCACGACGGAGCTGCGCGACAAGCGCGAGA
AGAAGAACGCCCTGTTCTACAAGCTGGACATCGTGCAGCTGGGCGGCAACTCCTCGCAGTACAGGCTGATCAACTGCAA
CACCTCCGTCATCACGCAGGCGTGCCCCAAGGTGTCCTTCGACCCCATCCCCATCCACTACTGCGCCCCCGCCGGCTAC
GCCATCCTGAAGTGCAACAACAAGACCTTCAACGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCGAAGAA
CATCACGGACAACAGCAAGACCATCATCGTGCACCTGAACGAGTCCGTGAAGATCGAGTGCACCCGCCCGAGCAACAAC
ACGCGCACCTCCATCCGGATCGGCCCTGGCCAGGCCTTCTACGCCACCGGCCAGGTGATCGGCAACATCCGCGAGGCGC
ACTGCAACATCTCCGAGTCCAAGTGGAACGAGACCCTGCAGCGCGTGTCCGAGAAGCTGAAGAAGTACTTCCCCGACAA
GAACATCACCTTCCGGCCGTCGTCCGGCGGCGACCTCGAGATCACCACGCACTCCTTCAACTGCGGTGGCGAGTTCTTC
TACTGCAACACGTCGTCCCTGTTCAACCGCACCTACATGGCGACGTCCACCGACATGGCCAACTCCACCGAGACGAACT
CCACGCGCATCATCACGATCCACTGCCGCATCAAGCAGATCATCAACATGTGGCAGGAGGTGGGCCGCGCCATGTACGC
ACCGCCCATCGCCGGCAACATCACCTGCATCTCCAACATCACCGGCCTCCTGCTGACCCGCGACGGCGGCAACAACACG
GAGGACACGGAGACCTTCAGGCCAGAGGGAGGCAACATGAAGGACAACTGGCGCTCCGAGCTGTACAAGTACAAGGTGG
TGGAGGTGAAGCCCCTGGGCGTGGCACCCACCAACGCCCGCGAGCGCGTCGTGGAGCGCGAGAAGGAGTAGTAAGgtca
ccgggtcccgaattcggatcc >HV1300531_v2, CH505.M5D8gp120 (SEQ ID NO. 151)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLNCTNATASNSSIIEGMKNCSFNITTELRDKREKKNALFYKL
DIVQLDGNSSQYRLINCNTSVITQACPKVSFDPIPIHYCAPAGYAILKCNNKTFTGTGPCNNVSTVQCTHGIKPVVSTQ
LLLNGSLAEGEIIIRSENITKNVKTIIVHLNESVKIECTRPNNKTRTSIRIGPGQAFYATGQVIGDIREAYCNINESKW
NETLQRVSKKLKEYFPHKNITFQPSSGGDLEITTHSFNCGGEFFYCNTSSLFNRTYMANSTDMANSTETNSTRTITIHC
RIKQIINMWQEVGRAMYAPPIAGNITCISNITGLLLTRDGGKNNTETFRPGGGNMKDNWRSELYKYKVVEVKPLGVAPT
NARERVVEREKE

Figure 17A cont.

>HV1300537_v2, CH505.M11D8gp120 (SEQ ID NO. 152)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLNCTNATASNSSIIEGMKNCSFNITTELRDKREKKNALFYKL
DIVQLDGNSSQYRLINCNTSVITQACPKVSFDPIPIHYCAPAGYAILKCNNKTFTGTGPCNNVSTVQCTHGIKPVVSTQ
LLLNGSLAEGEIIIRSENITDNGKTIIVHLNESVKIECTRPNNKTRTSIRIGPGQAFYATGQVIGDIREAYCNINESKW
NETLQRVSKKLKEYFPHKNITFQPSSGGDLEITTHSFNCGGEFFYCNTSSLFNRTYMANSTDMANSTETNSTRTITIHC
RIKQIINMWQEVGRAMYAPPIAGNITCISNITGLLLTRDGGKNNTETFRPGGGNMKDNWRSELYKYKVVEVKPLGVAPT
NARERVVEREKE

>HV1300556_v2, CH505w020.14D8gp120 (SEQ ID NO. 153)
MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLNCTNATASNNSIIEGMKNCSFNITTELRDKREKKNALFYKL
DIVQLDGNSSQYRLINCNTSVITQACPKVSFDPIPIHYCAPAGYAILKCNNKTFTGTGPCNNVSTVQCTHGIKPVVSTQ
LLLNGSLAEGEIIIRSENITNNAKTIIVHLNESVKIECTRPNNKTRTSIRIGPGQAFYATGQVIGDIRKAYCNISESKW
NETLQRVSKKLKEYFPHKNITFQPSSGGDLEITTHSFNCGGEFFYCNTSSLFNRTYMANSTDMANSTETNSTRTITLHC
RIKQIINMWQEVGRAMYAPPIAGNITCISNITGLLLTRDGGKNNTETFRPGGGNMKDNWRSELYKYKVVEVKPLGVAPT
NARERVVEREKE

>HV1300573_v2, CH505w030.20D8gp120 (SEQ ID NO. 154)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLNCTNATTNATASNSSIIEGMKNCSFNITTELRDKREKKNAL
FYKLDIVQLDGNSSQYRLINCNTSVITQACPKVSFDPIPIHYCAPAGYAILKCNNKTFTGTGPCNNVSTVQCTHGIKPV
VSTQLLLNGSLAEGEIIIRSENITNNAKTIIVHLNESVKIECTRPNNKTRTSIRIGPGQAFYATGQVIGDIREAYCNIS
ESKWNETLQRVSKKLKEYFPHKNITFQPSSGGDLEITTHSFNCGGEFFYCNTSSLFNRTYMANSTDMANSTETNSTRII
TIHCRIKQIINMWQEVGRAMYAPPIAGNITCISNITGLLLTRDGGKNTRDGGKNNTETFRPGGGNMKDNWRSELYKYKV
VEVKPLGVAPTNARERVVEREKE

>HV1300778, CH505.w30.12D8gp120 (SEQ ID NO. 155)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLNCTNATNATASNSSIIEGMKNCSFNITTELRDKREKKNALF
YKLDIVQLDGNSSQYRLINCNTSVITQACPKVSFDPIPIHYCAPAGYAILKCNNKTFTGTGPCNNVSTVQCTHGIKPVV
STQLLLNGSLAEGEIIIRSENITNNDKTIIVHLNESVKIECTRPSNKTRTSIRIGPGQAFYATGQVIGDIREAYCNISE
SKWNETLQRVSKKLKEYFPHKNITFQPSSGGDLEITTHSFNCGGEFFYCNTSSLFNRTYMANSTDMANSTETNSTRNIT
IHCRIKQIINMWQEVGRAMYAPPIAGNITCISNITGLLLTRDGGKNDTETFRPGGGNMKDNWRSELYKYKVVEVKPLGV
APTNARERVVEREKE

Figure 17A cont.

>HV1300612, CH505w136.B8D8gp120 (SEQ ID NO. 156)

MRVRGIQRSYPQWWIWSMLGFWMLMICNGVPVWKEAKTTLFCASDAKAYEKEVHNVWATHACVPTDPNPQEMVLKNVTE
NFNMWENDMVDQMHEDVISLWDQSLKPCVKLTPLCVTLNCINATNATDSNSNILEGMKNCSFNITTELRDKREKKNALF
YKLDIVQLGGNSSQYRLINCNTSVITQACPKVSFDPIPIHYCAPAGYAILKCNNKTFNGTGPCNNVSTVQCTHGIKPVV
STQLLLNGSLAEGEIIIRSKNITDNSKTIIVHLNESVKIECTRPSNNTRTSIRIGPGQAFYATGQVIGNIREAHCNISE
SKWNETLQRVSEKLKKYFPDKNITFRPSSGGDLEITTHSFNCGGEFFYCNTSSLFNRTYMATSTDMANSTETNSTRIIT
IHCRIKQIINMWQEVGRAMYAPPIAGNITCISNITGLLLTRDGGNNTEDTETFRPEGGNMKDNWRSELYKYKVVEVKPL
GVAPTNARERVVEREKE

Figure 17A cont.

>CH505.M5 gp160 (SEQ ID NO. 157)

GgtcgacaagaaATGCGCGTGATGGGCATCCAGCGCAACTACCCGCAGTGGTGGATCTGGTCGATGCTGGGCTTCTGGA
TGCTCATGATCTGCAACGGCATGTGGGTGACGGTGTACTACGGCGTGCCGGTGTGGAAGGAGGCCAAGACGACCCTGTT
CTGCGCGTCGGACGCCAAGGCCTACGAGAAGGAGGTGCACAACGTGTGGGCGACCCACGCCTGCGTGCCCACGGACCCC
AACCCGCAGGAGATGGTGCTGAAGAACGTGACCGAGAACTTCAACATGTGGAAGAACGACATGGTGGACCAGATGCACG
AGGACGTGATCTCCCTGTGGGACCAGTCCCTGAAGCCCTGCGTGAAGCTGACCCCGCTGTGCGTGACCCTGAACTGCAC
CAACGCCACCGCGTCCAACTCCTCCATCATCGAGGGCATGAAGAACTGCTCCTTCAACATCACGACGGAGCTGCGCGAC
AAGCGCGAGAAGAAGAACGCCCTGTTCTACAAGCTGGACATCGTGCAGCTGGACGGCAACTCCTCGCAGTACAGGCTGA
TCAACTGCAACACCTCCGTCATCACGCAGGCGTGCCCCAAGGTGTCCTTCGACCCCATCCCCATCCACTACTGCGCCCC
CGCCGGCTACGCCATCCTGAAGTGCAACAACAAGACCTTCACCGGCACCGGCCCGTGCAACAACGTGTCCACCGTGCAG
TGCACGCACGGGATCAAGCCCGTGGTGTCCACGCAGCTGCTCCTGAACGGGTCGCTGGCCGAGGGCGAGATCATCATCC
GGTCCGAGAACATCACGAAGAACGTGAAGACCATCATCGTGCACCTGAACGAGTCCGTGAAGATCGAGTGCACCCGCCC
GAACAACAAGACGCGCACCTCCATCCGGATCGGCCCTGGCCAGGCCTTCTACGCCACCGGCCAGGTGATCGGCGACATC
CGCGAGGCGTACTGCAACATCAACGAGTCCAAGTGGAACGAGACCCTGCAGCGCGTGTCCAAGAAGCTGAAGGAGTACT
TCCCCCACAAGAACATCACCTTCCAGCCGTCGTCCGGCGGCGACCTCGAGATCACCACGCACTCCTTCAACTGCGGTGG
CGAGTTCTTCTACTGCAACACGTCGTCGCTGTTCAACCGCACCTACATGGCCAACTCCACCGACATGGCCAACTCCACC
GAGACCAACTCCACGCGCACCATCACGATCCACTGCCGCATCAAGCAGATCATCAACATGTGGCAGGAGGTGGGCCGCG
CCATGTACGCACCGCCCATCGCCGGCAACATCACCTGCATCTCCAACATCACCGGCCTCCTGCTGACCCGCGACGGCGG
CAAGAACAACACGGAGACCTTCAGGCCAGGCGGAGGCAACATGAAGGACAACTGGCGCTCCGAGCTGTACAAGTACAAG
GTGGTGGAGGTGAAGCCCCTGGGCGTGGCACCCACCAACGCCCGCAGGCGCGTCGTGGAGCGCGAGAAGCGCGCCGTGG
GCATGGGCGCCGTGTTCCTGGGCTTCCTGGGCGCTGCGGGCTCCACCATGGGTGCCGCGTCCATCACCCTGACCGTGCA
GGCCCGCCAGCTGCTCTCCGGCATCGTGCAGCAGCAGTCCAACCTCCTGAAGGCCATCGAGGCCCAGCAGCACATGCTG
AAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCAACGTGTACTGGAACTCGTCCTGGTCCAACAAGACCTA
CGGCGACATCTGGGACAACATGACCTGGATGCAGTGGGAGCGCGAGATCTCCAACTACACCGAGATCATCTACGAGCTC
CTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCAT
CTTCGCCGTGCTGTCGCTGGTGAACCGCGTGCGCCAGGGCTACTCCCCGCTGTCCCTGCAAACGCTGATCCCCTCCCCC
CGGGGCCCGGACAGGCCCGGTGGCATCGAGGAGGAGGGCGGCGAGCAGGACCGCAACCGCTCCACGCGCCTGGTGTCCG
GCTTCCTGGCCCTGGTGTGGGACGACCTGCGCTCCCTGTGCCTGTTCATCTACCACCGCCTGCGCGACTTCATCCTGAT
CGCGGCCCGCGCTGGCGAGCTGCTGGGCCGGTCCTCGCTGAAGGGCCTGCGCCGCGGCTGGGAGGCCCTGAAGTACCTG
GGCTCGCTGGTGCAGTACTGGGGCCTGGAGCTGAAGCGCTCCGCCATCTCCCTGCTGGACACCCTGGCCATCGCCGTGG
GCGAGGGCACCGACCGCATCCTGGAGTTCGTGCTGGGCATCTGCCGCGCCATCCGCAACATCCCCACCCGCATCCGCCA
GGGCTTCGAGACCGCCCTCCTGTAGTAAGgtgaccgaattcgggacccggatcc

Figure 17B

>CH505.M11 gp160 (SEQ ID NO. 158)

GgtcgacaagaaATGCGCGTGATGGGCATCCAGCGCAACTACCCGCAGTGGTGGATCTGGTCGATGCTGGGCTTCTGGA
TGCTCATGATCTGCAACGGCATGTGGGTGACGGTGTACTACGGCGTGCCGGTGTGGAAGGAGGCCAAGACGACCCTGTT
CTGCGCGTCGGACGCCAAGGCCTACGAGAAGGAGGTGCACAACGTGTGGGCGACCCACGCCTGCGTGCCCACGGACCCC
AACCCGCAGGAGATGGTGCTGAAGAACGTGACCGAGAACTTCAACATGTGGAAGAACGACATGGTGGACCAGATGCACG
AGGACGTGATCTCCCTGTGGGACCAGTCCCTGAAGCCCTGCGTGAAGCTGACCCCGCTGTGCGTGACCCTGAACTGCAC
CAACGCCACCGCGTCCAACTCCTCCATCATCGAGGGCATGAAGAACTGCTCCTTCAACATCACGACGGAGCTGCGCGAC
AAGCGCGAGAAGAAGAACGCCCTGTTCTACAAGCTGGACATCGTGCAGCTGGACGGCAACTCCTCGCAGTACAGGCTGA
TCAACTGCAACACCTCCGTCATCACGCAGGCGTGCCCCAAGGTGTCCTTCGACCCCATCCCCATCCACTACTGCGCCCC
CGCCGGCTACGCCATCCTGAAGTGCAACAACAAGACCTTCACCGGCACCGGCCCGTGCAACAACGTGTCCACCGTGCAG
TGCACGCACGGGATCAAGCCCGTGGTGTCCACGCAGCTGCTCCTGAACGGGTCGCTGGCCGAGGGCGAGATCATCATCC
GGTCCGAGAACATCACGGACAACGGGAAGACCATCATCGTGCACCTGAACGAGTCCGTGAAGATCGAGTGCACCCGCCC
GAACAACAAGACGCGCACCTCCATCCGGATCGGCCCTGGCCAGGCCTTCTACGCCACCGGCCAGGTGATCGGCGACATC
CGCGAGGCGTACTGCAACATCAACGAGTCCAAGTGGAACGAGACCCTGCAGCGCGTGTCCAAGAAGCTGAAGGAGTACT
TCCCCCACAAGAACATCACCTTCCAGCCGTCGTCCGGCGGCGACCTCGAGATCACCACGCACTCCTTCAACTGCGGTGG
CGAGTTCTTCTACTGCAACACGTCGTCGCTGTTCAACCGCACCTACATGGCCAACTCCACCGACATGGCCAACTCCACC
GAGACCAACTCCACGCGCACCATCACGATCCACTGCCGCATCAAGCAGATCATCAACATGTGGCAGGAGGTGGGCCGCG
CCATGTACGCACCGCCCATCGCCGGCAACATCACCTGCATCTCCAACATCACCGGCCTCCTGCTGACCCGCGACGGCGG
CAAGAACAACACGGAGACCTTCAGGCCAGGCGGAGGCAACATGAAGGACAACTGGCGCTCCGAGCTGTACAAGTACAAG
GTGGTGGAGGTGAAGCCCCTGGGCGTGGCACCCACCAACGCCCGCAGGCGCGTCGTGGAGCGCGAGAAGCGCGCCGTGG
GCATGGGCGCCGTGTTCCTGGGCTTCCTGGGCGCTGCGGGCTCCACCATGGGTGCCGCGTCCATCACCCTGACCGTGCA
GGCCCGCCAGCTGCTCTCCGGCATCGTGCAGCAGCAGTCCAACCTCCTGAAGGCCATCGAGGCCCAGCAGCACATGCTG
AAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCAACGTGTACTGGAACTCGTCCTGGTCCAACAAGACCTA
CGGCGACATCTGGGACAACATGACCTGGATGCAGTGGGAGCGCGAGATCTCCAACTACACCGAGATCATCTACGAGCTC
CTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCAT
CTTCGCCGTGCTGTCGCTGGTGAACCGCGTGCGCCAGGGCTACTCCCCGCTGTCCCTGCAAACGCTGATCCCCTCCCCC
CGGGGCCCGGACAGGCCCGGTGGCATCGAGGAGGAGGGCGGCGAGCAGGACCGCAACCGCTCCACGCGCCTGGTGTCCG
GCTTCCTGGCCCTGGTGTGGGACGACCTGCGCTCCCTGTGCCTGTTCATCTACCACCGCCTGCGCGACTTCATCCTGAT
CGCGGCCCGCGCTGGCGAGCTGCTGGGCCGGTCCTCGCTGAAGGGCCTGCGCCGCGGCTGGGAGGCCCTGAAGTACCTG
GGCTCGCTGGTGCAGTACTGGGGCCTGGAGCTGAAGCGCTCCGCCATCTCCCTGCTGGACACCCTGGCCATCGCCGTGG
GCGAGGGCACCGACCGCATCCTGGAGTTCGTGCTGGGCATCTGCCGCGCCATCCGCAACATCCCCACCCGCATCCGCCA
GGGCTTCGAGACCGCCCTCCTGTAGTAAGgtgaccgaattcaggtcccggatcc

Figure 17B cont.

>CH505w020.14 gp160 (SEQ ID NO. 159)

GgtcgacaagaaATGCGCGTGATGGGCATCCAGCGCAACTACCCGCAGTGGTGGATCTGGTCGATGCTGGGCTTCTGGA
TGCTCATGATCTGCAACGGCATGTGGGTGACGGTGTACTACGGCGTGCCGGTGTGGAAGGAGGCCAAGACGACCCTGTT
CTGCGCGTCGGACGCCAAGGCCTACGAGAAGGAGGTGCACAACGTGTGGGCGACCCACGCCTGCGTGCCCACGGACCCC
AACCCGCAGGAGATGGTGCTGAAGAACGTGACCGAGAACTTCAACATGTGGAAGAACGACATGGTGGACCAGATGCACG
AGGACGTGATCTCCCTGTGGGACCAGTCCCTGAAGCCCTGCGTGAAGCTGACCCCGCTGTGCGTGACCCTGAACTGCAC
CAACGCCACCGCGTCCAACAACTCCATCATCGAGGGCATGAAGAACTGCTCCTTCAACATCACGACGGAGCTGCGCGAC
AAGCGCGAGAAGAAGAACGCCCTGTTCTACAAGCTGGACATCGTGCAGCTGGACGGCAACTCCTCGCAGTACAGGCTGA
TCAACTGCAACACCTCCGTCATCACGCAGGCGTGCCCCAAGGTGTCCTTCGACCCCATCCCCATCCACTACTGCGCCCC
CGCCGGCTACGCCATCCTGAAGTGCAACAACAAGACCTTCACCGGCACCGGCCCGTGCAACAACGTGTCCACCGTGCAG
TGCACGCACGGGATCAAGCCCGTGGTGTCCACGCAGCTGCTCCTGAACGGGTCGCTGGCCGAGGGCGAGATCATCATCC
GGTCCGAGAACATCACGAACAACGCGAAGACCATCATCGTGCACCTGAACGAGTCCGTGAAGATCGAGTGCACCCGCCC
GAACAACAAGACGCGCACGTCCATCCGGATCGGCCCTGGCCAGGCCTTCTACGCCACCGGCCAGGTGATCGGCGACATC
CGCAAGGCGTACTGCAACATCTCGGAGTCCAAGTGGAACGAGACCCTGCAGCGCGTGTCCAAGAAGCTGAAGGAGTACT
TCCCCCACAAGAACATCACCTTCCAGCCGTCGTCCGGCGGCGACCTCGAGATCACCACGCACTCCTTCAACTGCGGTGG
CGAGTTCTTCTACTGCAACACGTCGTCGCTGTTCAACCGCACCTACATGGCCAACTCCACCGACATGGCCAACTCCACC
GAGACCAACTCCACGCGCACCATCACGCTCCACTGCCGCATCAAGCAGATCATCAACATGTGGCAGGAGGTGGGCCGCG
CCATGTACGCACCGCCCATCGCCGGCAACATCACCTGCATCTCCAACATCACCGGCCTCCTGCTGACCCGCGACGGCGG
CAAGAACAACACGGAGACCTTCAGGCCAGGCGGAGGCAACATGAAGGACAACTGGCGCTCCGAGCTGTACAAGTACAAG
GTGGTGGAGGTGAAGCCCCTGGGCGTGGCACCCACCAACGCCCGCAGGCGCGTCGTGGAGCGCGAGAAGCGCGCCGTGG
GCATGGGCGCCGTGTTCCTGGGCTTCCTGGGCGCTGCGGGCTCCACCATGGGTGCCGCGTCCATCACCCTGACCGTGCA
GGCCCGCCAGCTGCTCTCCGGCATCGTGCAGCAGCAGTCCAACCTCCTGAAGGCCATCGAGGCCCAGCAGCACATGCTG
AAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCAACGTGTACTGGAACTCGTCCTGGTCCAACAAGACCTA
CGGCGACATCTGGGACAACATGACCTGGATGCAGTGGGAGCGCGAGATCTCCAACTACACCGAGATCATCTACGAGCTC
CTCGAGGAGTCCCAGAACCAGCAGGAGAAGAACGAGCAGGATCTGCTCGCGCTGGACCGCTGGAACTCCCTGTGGAACT
GGTTCAACATCACCAACTGGCTGTGGTACATCAAGATCTTCATCATGATCGTGGGCGGCCTGATCGGCCTGCGCATCAT
CTTCGCCGTGCTGTCGCTGGTGAACCGCGTGCGCCAGGGCTACTCCCCGCTGTCCCTGCAAACGCTGATCCCCTCCCCC
CGGGGCCCGGACAGGCCCGGTGGCATCGAGGAGGAGGGCGGCGAGCAGGACCGCAACCGCTCCACGCGCCTGGTGTCCG
GCTTCCTGGCCCTGGTGTGGGACGACCTGCGCTCCCTGTGCCTGTTCATCTACCACCGCCTGCGCGACTTCATCCTGAT
CGCGGCCCGCGCTGGCGAGCTGCTGGGCCGGTCCTCGCTGAAGGGCCTGCGCCGCGGCTGGGAGGCCCTGAAGTACCTG
GGCTCGCTGGTGCAGTACTGGGGCCTGGAGCTGAAGCGCTCCGCCATCTCCCTGCTGGACACCCTGGCCATCGCCGTGG
GCGAGGGCACCGACCGCATCCTGGAGTTCGTGCTGGGCATCTGCCGCGCCATCCGCAACATCCCCACCCGCATCCGCCA
GGGCTTCGAGACCGCCCTCCTGTAGTAAGggacccgaattcggtcaccggatcc

Figure 17B cont.

>CH505w030.20 gp160 (SEQ ID NO. 160)

GgtcgacaagaaATGCGCGTGATGGGCATCCAGCGCAACTACCCGCAGTGGTGGATCTGGTCGATGCTGGGCTTCTGGA
TGCTCATGATCTGCAACGGCATGTGGGTGACGGTGTACTACGGCGTGCCGGTGTGGAAGGAGGCCAAGACGACCCTGTT
CTGCGCGTCGGACGCCAAGGCCTACGAGAAGGAGGTGCACAACGTGTGGGCGACCCACGCCTGCGTGCCCACGGACCCC
AACCCGCAGGAGATGGTGCTGAAGAACGTGACCGAGAACTTCAACATGTGGAAGAACGACATGGTGGACCAGATGCACG
AGGACGTGATCTCCCTGTGGGACCAGTCCCTGAAGCCCTGCGTGAAGCTGACCCCGCTGTGCGTGACCCTGAACTGCAC
CAACGCGACGACCAACGCCACCGCGTCCAACTCCTCCATCATCGAGGGCATGAAGAACTGCTCCTTCAACATCACGACG
GAGCTGCGCGACAAGCGCGAGAAGAAGAACGCCCTGTTCTACAAGCTGGACATCGTGCAGCTGGACGGCAACTCCTCGC
AGTACAGGCTGATCAACTGCAACACCTCCGTCATCACGCAGGCGTGCCCCAAGGTGTCCTTCGACCCCATCCCCATCCA
CTACTGCGCCCCCGCCGGCTACGCCATCCTGAAGTGCAACAACAAGACCTTCACCGGCACCGGCCCGTGCAACAACGTG
TCCACCGTGCAGTGCACGCACGGGATCAAGCCCGTGGTGTCCACGCAGCTGCTCCTGAACGGGTCGCTGGCCGAGGGCG
AGATCATCATCCGGTCCGAGAACATCACGAACAACGCGAAGACCATCATCGTGCACCTGAACGAGTCCGTGAAGATCGA
GTGCACCCGCCCGAACAACAAGACGCGCACCTCCATCCGGATCGGCCCTGGCCAGGCCTTCTACGCCACCGGCCAGGTG
ATCGGCGACATCCGCGAGGCGTACTGCAACATCAGCGAGTCCAAGTGGAACGAGACCCTGCAGCGCGTGTCCAAGAAGC
TGAAGGAGTACTTCCCCCACAAGAACATCACCTTCCAGCCGTCGTCCGGCGGCGACCTCGAGATCACCACGCACTCCTT
CAACTGCGGTGGCGAGTTCTTCTACTGCAACACGTCGTCGCTGTTCAACCGCACCTACATGGCCAACTCCACCGACATG
GCCAACTCCACCGAGACCAACTCCACGCGCATCATCACGATCCACTGCCGCATCAAGCAGATCATCAACATGTGGCAGG
AGGTGGGCCGCGCCATGTACGCACCGCCCATCGCCGGCAACATCACCTGCATCTCCAACATCACCGGCCTCCTGCTGAC
CCGCGACGGCGGCAAGAACACGAGGGACGGAGGCAAGAACAACACGGAGACCTTCAGGCCAGGCGGAGGCAACATGAAG
GACAACTGGCGCTCCGAGCTGTACAAGTACAAGGTGGTGGAGGTGAAGCCCCTGGGCGTGGCACCCACCAACGCCCGCA
GGCGCGTCGTGGAGCGCGAGAAGCGCGCCGTGGGCATGGGCGCCGTGTTCCTGGGCTTCCTGGGCGCTGCGGGCTCCAC
CATGGGTGCCGCGTCCATCACCCTGACCGTGCAGGCCCGCCAGCTGCTCTCCGGCATCGTGCAGCAGCAGTCCAACCTC
CTGAAGGCCATCGAGGCCCAGCAGCACATGCTGAAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACCACCAACGT
GTACTGGAACTCGTCCTGGTCCAACAAGACCTACGGCGACATCTGGGACAACATGACCTGGATGCAGTGGGAGCGCGAG
ATCTCCAACTACACCGAGATCATCTACGAGCTCCTCGAGGAGTCCCAGAACCAGCAGGAGAAGAACGAGCAGGATCTGC
TCGCGCTGGACCGCTGGAACTCCCTGTGGAACTGGTTCAACATCACCAACTGGCTGTGGTACATCAAGATCTTCATCAT
GATCGTGGGCGGCCTGATCGGCCTGCGCATCATCTTCGCCGTGCTGTCGCTGGTGAACCGCGTGCGCCAGGGCTACTCC
CCGCTGTCCCTGCAAACGCTGATCCCCTCCCCCGGGGCCCGGACAGGCCCGGTGGCATCGAGGAGGAGGGCGGCGAGC
AGGACCGCAACCGCTCCACGCGCCTGGTGTCCGGCTTCCTGGCCCTGGCGTGGGACGACCTGCGCTCCCTGTGCCTGTT
CATCTACCACCGCCTGCGCGACTTCATCCTGATCGCGGCCCGCGCTGGCGAGCTGCTGGGCCGGTCCTCGCTGAAGGGC
CTGCGCCGCGGCTGGGAGGCCCTGAAGTACCTGGGCTCGCTGGTGCAGTACTGGGGCCTGGAGCTGAAGCGCTCCGCCA
TCTCCCTGCTGGACACCCTGGCCATCGCCGTGGGCGAGGGCACCGACCGCATCCTGGAGTTCGTGCTGGGCATCTGCCG
CGCCATCCGCAACATCCCCACCCGCATCCGCCAGGGCTTCGAGACCGCCCTCCTGTAGTAAGggtcctgaattcggtaa
ccggatcc

Figure 17B cont.

>CH505.w30.12gp160 (SEQ ID NO. 161)

ggtcgacaagaagccaccATGCGCGTGATGGGCATCCAGCGCAACTACCCGCAGTGGTGGATCTGGTCGATGCTGGGCT
TCTGGATGCTCATGATCTGCAACGGCATGTGGGTGACGGTGTACTACGGCgtgccggtgTGGAAGGAGGCCAAGACGAC
CCTGTTCTGCGCGTCGGACGCCAAGGCCTACGAGAAGGAGGTGCACAACGTGTGGGCGACCCACGCCTGCGTGCCCACG
GACCCCAACCCGCAGGAGATGGTGCTGAAGAACGTGACCGAGAACTTCAACATGTGGAAGAACGACATGGTGGACCAGA
TGCACGAGGACGTGATCTCCCTGTGGGACCAGTCCCTGAAGCCCTGCGTGAAGCTGACCCCGCTGTGCGTGACCCTGAA
CTGCACCAACGCGACCAACGCCACCGCGTCCAACTCCTCCATCATCGAGGGCATGAAGAACTGCTCCTTCAACATCACG
ACGGAGCTGCGCGACAAGCGCGAGAAGAAGAACGCCCTGTTCTACAAGCTGGACATCGTGCAGCTGGACGGCAACTCCT
CGCAGTACAGGCTGATCAACTGCAACACCTCCGTCATCACGCAGGCGTGCCCCAAGGTGTCCTTCGACCCCATCCCCAT
CCACTACTGCGCCCCCGCCGGCTACGCCATCCTGAAGTGCAACAACAAGACCTTCACCGGCACCGGCCCGTGCAACAAC
GTGTCCACCGTGCAGTGCACGCACGGGATCAAGCCCGTGGTGTCCACGCAGCTGCTCCTGAACGGGTCGCTGGCCGAGG
GCGAGATCATCATCCGGTCCGAGAACATCACGAACAACGACAAGACCATCATCGTGCACCTGAACGAGTCCGTGAAGAT
CGAGTGCACCCGCCCGAGCAACAAGACGCGCACCTCCATCCGGATCGGCCCTGGCCAGGCCTTCTACGCCACCGGCCAG
GTGATCGGCGACATCCGCGAGGCGTACTGCAACATCAGCGAGTCCAAGTGGAACGAGACCCTGCAGCGCGTGTCCAAGA
AGCTGAAGGAGTACTTCCCCCACAAGAACATCACCTTCCAGCCGTCGTCCGGCGGCGACCTCGAGATCACCACGCACTC
CTTCAACTGCGGTGGCGAGTTCTTCTACTGCAACACGTCGTCGCTGTTCAACCGCACCTACATGGCCAACTCCACCGAC
ATGGCCAACTCCACCGAGACCAACTCCACGCGCAACATCACGATCCACTGCCGCATCAAGCAGATCATCAACATGTGGC
AGGAGGTGGGCCGCGCCATGTACGCACCGCCCATCGCCGGCAACATCACCTGCATCTCCAACATCACCGGCCTCCTGCT
GACCCGCGACGGCGGCAAGAACGACACGGAGACCTTCAGGCCAGGCGGAGGCAACATGAAGGACAACTGGCGCTCCGAG
CTGTACAAGTACAAGGTGGTGGAGGTGAAGCCCCTGGGCGTGGCACCCACCAACGCCcgcaggcgcgtcgtggagcgcg
agaagcgcGCCGTGGGCATGGGCGCCGTGTTCCTGGGCTTCCTGGGCGCTGCGGGCTCCACCATGGGTGCCGCGTCCAT
CACCCTGACCGTGCAGGCCCGCCAGCTGCTCTCCGGCATCGTGCAGCAGCAGTCCAACCTCCTGAAGGCCATCGAGGCC
CAGCAGCACATGCTGAAGCTGACCGTGTGGGGCATCAAGCAGCTGCAGGCCAGGGTGCTCGCGCTCGAGCGCTACCTGA
AGGACCAGCAGCTGCTCGGCATGTGGGGCTGCTCCGGCAAGCTGATCTGCACCACCAACGTGTACTGGAACTCGTCCTG
GTCCAACAAGACCTACGGCGACATCTGGGACAACATGACCTGGATGCAGTGGGAGCGCGAGATCTCCAACTACACCGAG
ATCATCTACGAGCTCCTCGAGGAGTCCCAGAACCAGCAGGAGAAGAACGAGCAGGATCTGCTCGCGCTGGACCGCTGGA
ACTCCCTGTGGAACTGGTTCAACATCACCAACTGGCTGTGGTACATCAAGATCTTCATCATGATCGTGGGCGGCCTGAT
CGGCCTGCGCATCATCTTCGCCGTGCTGTCGCTGGTGAACCGCGTGCGCCAGGGCTACTCCCCGCTGTCCCTGCAAACG
CTGATCCCCTCCCCCCGGGGCCCGGACAGGCCCGGTGGCATCGAGGAGGAGGGCGGCGAGCAGGACCGCAACCGCTCCA
CGCGCCTGGTGTCCGGCTTCCTGGCCCTGGTGTGGGACGACCTGCGCTCCCTGTGCCTGTTCATCTACCACCGCCTGCG
CGACTTCATCCTGATCGCGGCCCGCGCTGGCGAGCTGCTGGGCCGGTCCTCGCTGAAGGGCCTGCGCCGCGGCTGGGAG
GCCCTGAAGTACCTGGGCTCGCTGGTGCAGTACTGGGGCCTGGAGCTGAAGCGCTCCGCCATCTCCCTGCTGGACACCC
TGGCCATCGCCGTGGGCGAGGGCACCGACCGCATCCTGGAGTTCGTGCTGGGCATCTGCCGCGCCATCCGCAACATCCC
CACCCGCATCCGCCAGGGCTTCGAGACCGCCCTCCTGTGATGAGaggtcccggtaaccggatcc

Figure 17B cont.

>CH505w136.B8 gp160 (SEQ ID NO. 162)

GgtcgacaagaaATGCGCGTGCGCGGCATCCAGCGCAGCTACCCGCAGTGGTGGATCTGGTCGATGCTGGGCTTCTGGA
TGCTCATGATCTGCAACGGCATGTGGGTGACGGTGTACTACGGCGTGCCGGTGTGGAAGGAGGCCAAGACGACCCTGTT
CTGCGCGTCGGACGCCAAGGCCTACGAGAAGGAGGTGCACAACGTGTGGGCGACCCACGCCTGCGTGCCCACGGACCCC
AACCCGCAGGAGATGGTGCTGAAGAACGTGACCGAGAACTTCAACATGTGGGAGAACGACATGGTGGACCAGATGCACG
AGGACGTGATCTCCCTGTGGGACCAGTCCCTGAAGCCCTGCGTGAAGCTGACCCCGCTGTGCGTGACCCTGAACTGCAT
CAACGCCACCAACGCGACGGACTCGAACTCCAACATCCTCGAGGGGATGAAGAACTGCTCCTTCAACATCACGACGGAG
CTGCGCGACAAGCGCGAGAAGAAGAACGCCCTGTTCTACAAGCTGGACATCGTGCAGCTGGGCGGCAACTCCTCGCAGT
ACAGGCTGATCAACTGCAACACCTCCGTCATCACGCAGGCGTGCCCCAAGGTGTCCTTCGACCCCATCCCCATCCACTA
CTGCGCCCCCGCCGGCTACGCCATCCTGAAGTGCAACAACAAGACCTTCAACGGCACCGGCCCGTGCAACAACGTGTCC
ACCGTGCAGTGCACGCACGGGATCAAGCCCGTGGTGTCCACGCAGCTGCTCCTGAACGGGTCGCTGGCCGAGGGCGAGA
TCATCATCCGGTCGAAGAACATCACGGACAACAGCAAGACCATCATCGTGCACCTGAACGAGTCCGTGAAGATCGAGTG
CACCCGCCCGAGCAACAACACGCGCACCTCCATCCGGATCGGCCCTGGCCAGGCCTTCTACGCCACCGGCCAGGTGATC
GGCAACATCCGCGAGGCGCACTGCAACATCTCCGAGTCCAAGTGGAACGAGACCCTGCAGCGCGTGTCCGAGAAGCTGA
AGAAGTACTTCCCCGACAAGAACATCACCTTCCGGCCGTCGTCCGGCGGCGACCTCGAGATCACCACGCACTCCTTCAA
CTGCGGTGGCGAGTTCTTCTACTGCAACACGTCGTCCCTGTTCAACCGCACCTACATGGCGACGTCCACCGACATGGCC
AACTCCACCGAGACGAACTCCACGCGCATCATCACGATCCACTGCCGCATCAAGCAGATCATCAACATGTGGCAGGAGG
TGGGCCGCGCCATGTACGCACCGCCCATCGCCGGCAACATCACCTGCATCTCCAACATCACCGGCCTCCTGCTGACCCG
CGACGGCGGCAACAACACGGAGGACACGGAGACCTTCAGGCCAGAGGGAGGCAACATGAAGGACAACTGGCGCTCCGAG
CTGTACAAGTACAAGGTGGTGGAGGTGAAGCCCCTGGGCGTGGCACCCACCAACGCCCGCAGGCGCGTCGTGGAGCGCG
AGAAGCGCGCCGTGGGCATGGGCGCCGTGTTCCTGGGCTTCCTGGGCGCTGCGGGCTCCACCATGGGTGCCGCGTCCAT
CACCCTGACCGTGCAGGCCCGCCAGCTGCTCTCCGGCATCGTGCAGCAGCAGTCCAACCTCCTGAAGGCCATCGAGGCC
CAGCAGCACATGCTGAAGCTGACCGTGTGGGGCATCAAGCAGCTGCAGGCCAGGGTGCTCGCGCTCGAGCGCTACCTGA
AGGACCAGCAGCTGCTCGGCATGTGGGGCTGCTCCGGCAAGCTGATCTGCACCACCAACGTGTACTGGAACTCGTCCTG
GTCCAACAAGACCTACGACGACATCTGGGACAACATGACCTGGATGCAGTGGGAGCGCGAGATCTCCAACTACACCAAC
ATCATCTACGAGCTCCTCGAGGAGTCCCAGAACCAGCAGGAGAAGAACGAGCAGGATCTGCTCGCGCTGGACCGCTGGA
ACTCCCTGTGGAACTGGTTCAACATCACCAACTGGCTGTGGTACATCAAGATCTTCATCATGATCGTGGGCGGCCTGAT
CGGCCTGCGCATCATCTTCGCCGTGCTGTCGCTGGTGAACCGCGTGCGCCAGGGCTACTCCCCGCTGTCCCTGCAAACG
CTGATCCCCTCCCCCCGGGGCCCGGACAGGCCCGGTGGCATCGAGGAGGAGGGCGGCGAGCAGGACCGCAACCGCTCCA
CGCGCCTGGTGTCCGGCTTCCTGGCCCTGGCGTGGGACGACCTGCGCTCCCTGTGCCTGTTCATCTACCACCGCCTGCG
CGACTTCATCCTGATCGCGGCCCGCGCTGGCGAGCTGCTGGGCCGGTCCTCGCTGAAGGGCCTGCGCCGCGGCTGGGAG
GCCCTGAAGTACCTGGGCTCGCTGGTGCAGTACTGGGGCCTGGAGCTGAAGCGCTCCGCCATCTCCCTGCTGGACACCC
TGGCCATCGCCGTGGGCGAGGGCACCGACCGCATCCTGGAGTTCGTGCTGGGCATCTGCCGCGCCATCCGCAACATCCC
CACCCGCATCCGCCAGGGCTTCGAGACCGCCCTCCTGTAGTAAGgtcaccgggtcccgaattcggatcc

Figure 17B cont.

>CH505.M5gp160 (SEQ ID NO. 163)

MRVMGIQRNYPQWWIWSMLGFWMLMICNGMWVTVYYGVPVWKEAKTTLFCASDAKAYEKEVHNVWATHACVPTDPNPQEM
VLKNVTENFNMWKNDMVDQMHEDVISLWDQSLKPCVKLTPLCVTLNCTNATASNSSIIEGMKNCSFNITTELRDKREKKN
ALFYKLDIVQLDGNSSQYRLINCNTSVITQACPKVSFDPIPIHYCAPAGYAILKCNNKTFTGTGPCNNVSTVQCTHGIKP
VVSTQLLLNGSLAEGEIIIRSENITKNVKTIIVHLNESVKIECTRPNNKTRTSIRIGPGQAFYATGQVIGDIREAYCNIN
ESKWNETLQRVSKKLKEYFPHKNITFQPSSGGDLEITTHSFNCGGEFFYCNTSSLFNRTYMANSTDMANSTETNSTRTIT
IHCRIKQIINMWQEVGRAMYAPPIAGNITCISNITGLLLTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLKAIEAQQHMLKLTVWGIKQLQ
ARVLALERYLKDQQLLGMWGCSGKLICTTNVYWNSSWSNKTYGDIWDNMTWMQWEREISNYTEIIYELLEESQNQQEKNE
QDLLALDRWNSLWNWFNITNWLWYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLRRGWEALKYLGSLVQYWGLELKRS
AISLLDTLAIAVGEGTDRILEFVLGICRAIRNIPTRIRQGFETALL*

>CH505.M11 gp160 (SEQ ID NO. 164)

MRVMGIQRNYPQWWIWSMLGFWMLMICNGMWVTVYYGVPVWKEAKTTLFCASDAKAYEKEVHNVWATHACVPTDPNPQEM
VLKNVTENFNMWKNDMVDQMHEDVISLWDQSLKPCVKLTPLCVTLNCTNATASNSSIIEGMKNCSFNITTELRDKREKKN
ALFYKLDIVQLDGNSSQYRLINCNTSVITQACPKVSFDPIPIHYCAPAGYAILKCNNKTFTGTGPCNNVSTVQCTHGIKP
VVSTQLLLNGSLAEGEIIIRSENITDNGKTIIVHLNESVKIECTRPNNKTRTSIRIGPGQAFYATGQVIGDIREAYCNIN
ESKWNETLQRVSKKLKEYFPHKNITFQPSSGGDLEITTHSFNCGGEFFYCNTSSLFNRTYMANSTDMANSTETNSTRTIT
IHCRIKQIINMWQEVGRAMYAPPIAGNITCISNITGLLLTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLKAIEAQQHMLKLTVWGIKQLQ
ARVLALERYLKDQQLLGMWGCSGKLICTTNVYWNSSWSNKTYGDIWDNMTWMQWEREISNYTEIIYELLEESQNQQEKNE
QDLLALDRWNSLWNWFNITNWLWYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLRRGWEALKYLGSLVQYWGLELKRS
AISLLDTLAIAVGEGTDRILEFVLGICRAIRNIPTRIRQGFETALL*

Figure 17B cont.

>CH505w020.14 gp160 (SEQ ID NO. 165)

MRVMGIQRNYPQWWIWSMLGFWMLMICNGMWVTVYYGVPVWKEAKTTLFCASDAKAYEKEVHNVWATHACVPTDPNPQEM
VLKNVTENFNMWKNDMVDQMHEDVISLWDQSLKPCVKLTPLCVTLNCTNATASNNSIIEGMKNCSFNITTELRDKREKKN
ALFYKLDIVQLDGNSSQYRLINCNTSVITQACPKVSFDPIPIHYCAPAGYAILKCNNKTFTGTGPCNNVSTVQCTHGIKP
VVSTQLLLNGSLAEGEIIIRSENITNNAKTIIVHLNESVKIECTRPNNKTRTSIRIGPGQAFYATGQVIGDIRKAYCNIS
ESKWNETLQRVSKKLKEYFPHKNITFQPSSGGDLEITTHSFNCGGEFFYCNTSSLFNRTYMANSTDMANSTETNSTRTIT
LHCRIKQIINMWQEVGRAMYAPPIAGNITCISNITGLLLTRDGGKNNTETFRPGGGNMKDNWRSELYKYKVVEVKPLGVA
PTNARRRVVEREKRAVGMGAVFLGFLGAAGSTMGAASITLTVQARQLLSGIVQQQSNLLKAIEAQQHMLKLTVWGIKQLQ
ARVLALERYLKDQQLLGMWGCSGKLICTTNVYWNSSWSNKTYGDIWDNMTWMQWEREISNYTEIIYELLEESQNQQEKNE
QDLLALDRWNSLWNWFNITNWLWYIKIFIMIVGGLIGLRIIFAVLSLVNRVRQGYSPLSLQTLIPSPRGPDRPGGIEEEG
GEQDRNRSTRLVSGFLALVWDDLRSLCLFIYHRLRDFILIAARAGELLGRSSLKGLRRGWEALKYLGSLVQYWGLELKRS
AISLLDTLAIAVGEGTDRILEFVLGICRAIRNIPTRIRQGFETALL*

>CH505w030.20 gp160 (SEQ ID NO. 166)

MRVMGIQRNYPQWWIWSMLGFWMLMICNGMWVTVYYGVPVWKEAKTTLFCASDAKAYEKEVHNVWATHACVPTDPNPQEM
VLKNVTENFNMWKNDMVDQMHEDVISLWDQSLKPCVKLTPLCVTLNCTNATTNATASNSSIIEGMKNCSFNITTELRDKR
EKKNALFYKLDIVQLDGNSSQYRLINCNTSVITQACPKVSFDPIPIHYCAPAGYAILKCNNKTFTGTGPCNNVSTVQCTH
GIKPVVSTQLLLNGSLAEGEIIIRSENITNNAKTIIVHLNESVKIECTRPNNKTRTSIRIGPGQAFYATGQVIGDIREAY
CNISESKWNETLQRVSKKLKEYFPHKNITFQPSSGGDLEITTHSFNCGGEFFYCNTSSLFNRTYMANSTDMANSTETNST
RIITIHCRIKQIINMWQEVGRAMYAPPIAGNITCISNITGLLLTRDGGKNTRDGGKNNTETFRPGGGNMKDNWRSELYKY
KVVEVKPLGVAPTNARRRVVEREKRAVGMGAVFLGFLGAAGSTMGAASITLTVQARQLLSGIVQQQSNLLKAIEAQQHML
KLTVWGIKQLQARVLALERYLKDQQLLGMWGCSGKLICTTNVYWNSSWSNKTYGDIWDNMTWMQWEREISNYTEIIYELL
EESQNQQEKNEQDLLALDRWNSLWNWFNITNWLWYIKIFIMIVGGLIGLRIIFAVLSLVNRVRQGYSPLSLQTLIPSPRG
PDRPGGIEEEGGEQDRNRSTRLVSGFLALAWDDLRSLCLFIYHRLRDFILIAARAGELLGRSSLKGLRRGWEALKYLGSL
VQYWGLELKRSAISLLDTLAIAVGEGTDRILEFVLGICRAIRNIPTRIRQGFETALL*

Figure 17B cont.

>CH505w30.12 gp160 (SEQ ID NO. 167)

MRVMGIQRNYPQWWIWSMLGFWMLMICNGMWVTVYYGVPVWKEAKTTLFCASDAKAYEKEVHNVWATHACVPTDPNPQEM
VLKNVTENFNMWKNDMVDQMHEDVISLWDQSLKPCVKLTPLCVTLNCTNATNATASNSSIIEGMKNCSFNITTELRDKRE
KKNALFYKLDIVQLDGNSSQYRLINCNTSVITQACPKVSFDPIPIHYCAPAGYAILKCNNKTFTGTGPCNNVSTVQCTHG
IKPVVSTQLLLNGSLAEGEIIIRSENITNNDKTIIVHLNESVKIECTRPSNKTRTSIRIGPGQAFYATGQVIGDIREAYC
NISESKWNETLQRVSKKLKEYFPHKNITFQPSSGGDLEITTHSFNCGGEFFYCNTSSLFNRTYMANSTDMANSTETNSTR
NITIHCRIKQIINMWQEVGRAMYAPPIAGNITCISNITGLLLTRDGGKNDTETFRPGGGNMKDNWRSELYKYKVVEVKPL
GVAPTNARRRVVEREKRAVGMGAVFLGFLGAAGSTMGAASITLTVQARQLLSGIVQQQSNLLKAIEAQQHMLKLTVWGIK
QLQARVLALERYLKDQQLLGMWGCSGKLICTTNVYWNSSWSNKTYGDIWDNMTWMQWEREISNYTEIIYELLEESQNQQE
KNEQDLLALDRWNSLWNWFNITNWLWYIKIFIMIVGGLIGLRIIFAVLSLVNRVRQGYSPLSLQTLIPSPRGPDRPGGIE
EEGGEQDRNRSTRLVSGFLALVWDDLRSLCLFIYHRLRDFILIAARAGELLGRSSLKGLRRGWEALKYLGSLVQYWGLEL
KRSAISLLDTLAIAVGEGTDRILEFILGICRAIRNIPTRIRQGFETALL*

>CH505w136.B8 (SEQ ID NO. 168)

MRVRGIQRSYPQWWIWSMLGFWMLMICNGMWVTVYYGVPVWKEAKTTLFCASDAKAYEKEVHNVWATHACVPTDPNPQEM
VLKNVTENFNMWENDMVDQMHEDVISLWDQSLKPCVKLTPLCVTLNCINATNATDSNSNILEGMKNCSFNITTELRDKRE
KKNALFYKLDIVQLGGNSSQYRLINCNTSVITQACPKVSFDPIPIHYCAPAGYAILKCNNKTFNGTGPCNNVSTVQCTHG
IKPVVSTQLLLNGSLAEGEIIIRSKNITDNSKTIIVHLNESVKIECTRPSNNTRTSIRIGPGQAFYATGQVIGNIREAHC
NISESKWNETLQRVSEKLKKYFPDKNITFRPSSGGDLEITTHSFNCGGEFFYCNTSSLFNRTYMATSTDMANSTETNSTR
IITIHCRIKQIINMWQEVGRAMYAPPIAGNITCISNITGLLLTRDGGNNTEDTETFRPEGGNMKDNWRSELYKYKVVEVK
PLGVAPTNARRRVVEREKRAVGMGAVFLGFLGAAGSTMGAASITLTVQARQLLSGIVQQQSNLLKAIEAQQHMLKLTVWG
IKQLQARVLALERYLKDQQLLGMWGCSGKLICTTNVYWNSSWSNKTYDDIWDNMTWMQWEREISNYTNIIYELLEESQNQ
QEKNEQDLLALDRWNSLWNWFNITNWLWYIKIFIMIVGGLIGLRIIFAVLSLVNRVRQGYSPLSLQTLIPSPRGPDRPGG
IEEEGGEQDRNRSTRLVSGFLALAWDDLRSLCLFIYHRLRDFILIAARAGELLGRSSLKGLRRGWEALKYLGSLVQYWGL
ELKRSAISLLDTLAIAVGEGTDRILEFVLGICRAIRNIPTRIRQGFETALL*

Figure 17B cont.

| gp120 | Plasmid ID | gp145 | Plasmid ID |
|---|---|---|---|
| CH505.M5D8gp120 | HV1300531_v2 | CH505.M5gp145 | HV1300656 |
| CH505.M11D8gp120 | HV1300537_v2 | CH505.M11gp145 | HV1300662 |
| CH505w020.14D8gp120 | HV1300556_v2 | CH505w020.14gp145 | HV1300635 |
| CH505w030.20D8gp120 | HV1300573_v2 | CH505w30.20gp145 | HV1300688 |
| CH505.w30.12D8gp120 | HV1300778 | CH505.w30.12gp145 | HV1300646 |
| CH505w136.B18D8gp120 | HV1300615 | CH505w136.B18gp145 | HV1300724 |

>HV1300531_v2, CH505.M5D8gp120 (SEQ ID NO. 169)
gtgtcgacaagaagccaccATGCGCGTGATGGGCATCCAGCGCAACTACCCGCAGTGGTGGATCTGGTCGATGCTGGGC
TTCTGGATGCTCATGATCTGCAACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGT
GCTGAAGAACGTGACCGAGAACTTCAACATGTGGAAGAACGACATGGTGGACCAGATGCACGAGGACGTGATCTCCCTG
TGGGACCAGTCCCTGAAGCCCTGCGTGAAGCTGACCCCGCTGTGCGTGACCCTGAACTGCACCAACGCCACCGCGTCCA
ACTCCTCCATCATCGAGGGCATGAAGAACTGCTCCTTCAACATCACGACGGAGCTGCGCGACAAGCGCGAGAAGAAGAA
CGCCCTGTTCTACAAGCTGGACATCGTGCAGCTGGACGGCAACTCCTCGCAGTACAGGCTGATCAACTGCAACACCTCC
GTCATCACGCAGGCGTGCCCCAAGGTGTCCTTCGACCCCATCCCCATCCACTACTGCGCCCCCGCCGGCTACGCCATCC
TGAAGTGCAACAACAAGACCTTCACCGGCACCGGCCCGTGCAACAACGTGTCCACCGTGCAGTGCACGCACGGGATCAA
GCCCGTGGTGTCCACGCAGCTGCTCCTGAACGGGTCGCTGGCCGAGGGCGAGATCATCATCCGGTCCGAGAACATCACG
AAGAACGTGAAGACCATCATCGTGCACCTGAACGAGTCCGTGAAGATCGAGTGCACCCGCCCGAACAACAAGACGCGCA
CCTCCATCCGGATCGGCCCTGGCCAGGCCTTCTACGCCACCGGCCAGGTGATCGGCGACATCCGCGAGGCGTACTGCAA
CATCAACGAGTCCAAGTGGAACGAGACCCTGCAGCGCGTGTCCAAGAAGCTGAAGGAGTACTTCCCCCACAAGAACATC
ACCTTCCAGCCGTCGTCCGGCGGCGACCTCGAGATCACCACGCACTCCTTCAACTGCGGTGGCGAGTTCTTCTACTGCA
ACACGTCGTCGCTGTTCAACCGCACCTACATGGCCAACTCCACCGACATGGCCAACTCCACCGAGACCAACTCCACGCG
CACCATCACGATCCACTGCCGCATCAAGCAGATCATCAACATGTGGCAGGAGGTGGGCCGCGCCATGTACGCACCGCCC
ATCGCCGGCAACATCACCTGCATCTCCAACATCACCGGCCTCCTGCTGACCCGCGACGGCGGCAAGAACAACACGGAGA
CCTTCAGGCCAGGCGGAGGCAACATGAAGGACAACTGGCGCTCCGAGCTGTACAAGTACAAGGTGGTGGAGGTGAAGCC
CCTGGGCGTGGCACCCACCAACGCCCGCGAGCGCGTCGTGGAGCGCGAGAAGGAGTAGTAAGgtgaccgaattcgggac
ccggatcc

Figure 19A

>HV1300537_v2, CH505.M11D8gp120 (SEQ ID NO. 170)

gtgtcgacaagaagccaccATGCGCGTGATGGGCATCCAGCGCAACTACCCGCAGTGGTGGATCTGGTCGATGCTGGGC
TTCTGGATGCTCATGATCTGCAACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGT
GCTGAAGAACGTGACCGAGAACTTCAACATGTGGAAGAACGACATGGTGGACCAGATGCACGAGGACGTGATCTCCCTG
TGGGACCAGTCCCTGAAGCCCTGCGTGAAGCTGACCCCGCTGTGCGTGACCCTGAACTGCACCAACGCCACCGCGTCCA
ACTCCTCCATCATCGAGGGCATGAAGAACTGCTCCTTCAACATCACGACGGAGCTGCGCGACAAGCGCGAGAAGAAGAA
CGCCCTGTTCTACAAGCTGGACATCGTGCAGCTGGACGGCAACTCCTCGCAGTACAGGCTGATCAACTGCAACACCTCC
GTCATCACGCAGGCGTGCCCCAAGGTGTCCTTCGACCCCATCCCCATCCACTACTGCGCCCCCGCCGGCTACGCCATCC
TGAAGTGCAACAACAAGACCTTCACCGGCACCGGCCCGTGCAACAACGTGTCCACCGTGCAGTGCACGCACGGGATCAA
GCCCGTGGTGTCCACGCAGCTGCTCCTGAACGGGTCGCTGGCCGAGGGCGAGATCATCATCCGGTCCGAGAACATCACG
GACAACGGGAAGACCATCATCGTGCACCTGAACGAGTCCGTGAAGATCGAGTGCACCCGCCCGAACAACAAGACGCGCA
CCTCCATCCGGATCGGCCCTGGCCAGGCCTTCTACGCCACCGGCCAGGTGATCGGCGACATCCGCGAGGCGTACTGCAA
CATCAACGAGTCCAAGTGGAACGAGACCCTGCAGCGCGTGTCCAAGAAGCTGAAGGAGTACTTCCCCCACAAGAACATC
ACCTTCCAGCCGTCGTCCGGCGGCGACCTCGAGATCACCACGCACTCCTTCAACTGCGGTGGCGAGTTCTTCTACTGCA
ACACGTCGTCGCTGTTCAACCGCACCTACATGGCCAACTCCACCGACATGGCCAACTCCACCGAGACCAACTCCACGCG
CACCATCACGATCCACTGCCGCATCAAGCAGATCATCAACATGTGGCAGGAGGTGGGCCGCGCCATGTACGCACCGCCC
ATCGCCGGCAACATCACCTGCATCTCCAACATCACCGGCCTCCTGCTGACCCGCGACGGCGGCAAGAACAACACGGAGA
CCTTCAGGCCAGGCGGAGGCAACATGAAGGACAACTGGCGCTCCGAGCTGTACAAGTACAAGGTGGTGGAGGTGAAGCC
CCTGGGCGTGGCACCCACCAACGCCCGCGAGCGCGTCGTGGAGCGCGAGAAGGAGTAGTAAgtgaccgaattcaggtc
ccggatcc

Figure 19A cont.

>HV1300556_v2, CH505w020.14D8gp120 (SEQ ID NO. 171)

gtgtcgacaagaagccaccATGCGCGTGATGGGCATCCAGCGCAACTACCCGCAGTGGTGGATCTGGTCGATGCTGGGC
TTCTGGATGCTCATGATCTGCAACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGT
GCTGAAGAACGTGACCGAGAACTTCAACATGTGGAAGAACGACATGGTGGACCAGATGCACGAGGACGTGATCTCCCTG
TGGGACCAGTCCCTGAAGCCCTGCGTGAAGCTGACCCCGCTGTGCGTGACCCTGAACTGCACCAACGCCACCGCGTCCA
ACAACTCCATCATCGAGGGCATGAAGAACTGCTCCTTCAACATCACGACGGAGCTGCGCGACAAGCGCGAGAAGAAGAA
CGCCCTGTTCTACAAGCTGGACATCGTGCAGCTGGACGGCAACTCCTCGCAGTACAGGCTGATCAACTGCAACACCTCC
GTCATCACGCAGGCGTGCCCCAAGGTGTCCTTCGACCCCATCCCCATCCACTACTGCGCCCCCGCCGGCTACGCCATCC
TGAAGTGCAACAACAAGACCTTCACCGGCACCGGCCCGTGCAACAACGTGTCCACCGTGCAGTGCACGCACGGGATCAA
GCCCGTGGTGTCCACGCAGCTGCTCCTGAACGGGTCGCTGGCCGAGGGCGAGATCATCATCCGGTCCGAGAACATCACG
AACAACGCGAAGACCATCATCGTGCACCTGAACGAGTCCGTGAAGATCGAGTGCACCCGCCCGAACAACAAGACGCGCA
CGTCCATCCGGATCGGCCCTGGCCAGGCCTTCTACGCCACCGGCCAGGTGATCGGCGACATCCGCAAGGCGTACTGCAA
CATCTCGGAGTCCAAGTGGAACGAGACCCTGCAGCGCGTGTCCAAGAAGCTGAAGGAGTACTTCCCCCACAAGAACATC
ACCTTCCAGCCGTCGTCCGGCGGCGACCTCGAGATCACCACGCACTCCTTCAACTGCGGTGGCGAGTTCTTCTACTGCA
ACACGTCGTCGCTGTTCAACCGCACCTACATGGCCAACTCCACCGACATGGCCAACTCCACCGAGACCAACTCCACGCG
CACCATCACGCTCCACTGCCGCATCAAGCAGATCATCAACATGTGGCAGGAGGTGGGCCGCGCCATGTACGCACCGCCC
ATCGCCGGCAACATCACCTGCATCTCCAACATCACCGGCCTCCTGCTGACCCGCGACGGCGGCAAGAACAACACGGAGA
CCTTCAGGCCAGGCGGAGGCAACATGAAGGACAACTGGCGCTCCGAGCTGTACAAGTACAAGGTGGTGGAGGTGAAGCC
CCTGGGCGTGGCACCCACCAACGCCCGCGAGCGCGTCGTGGAGCGCGAGAAGGAGTAGTAAggacccgaattcggtca
ccggatcc

Figure 19A cont.

>HV1300573_v2, CH505w030.20D8gp120 (SEQ ID NO. 172)
gtgtcgacaagaagccaccATGCGCGTGATGGGCATCCAGCGCAACTACCCGCAGTGGTGGATCTGGTCGATGCTGGGC
TTCTGGATGCTCATGATCTGCAACGGCGTGCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAACCCGCAGGAGATGGT
GCTGAAGAACGTGACCGAGAACTTCAACATGTGGAAGAACGACATGGTGGACCAGATGCACGAGGACGTGATCTCCCTG
TGGGACCAGTCCCTGAAGCCCTGCGTGAAGCTGACCCCGCTGTGCGTGACCCTGAACTGCACCAACGCGACGACCAACG
CCACCGCGTCCAACTCCTCCATCATCGAGGGCATGAAGAACTGCTCCTTCAACATCACGACGGAGCTGCGCGACAAGCG
CGAGAAGAAGAACGCCCTGTTCTACAAGCTGGACATCGTGCAGCTGGACGGCAACTCCTCGCAGTACAGGCTGATCAAC
TGCAACACCTCCGTCATCACGCAGGCGTGCCCCAAGGTGTCCTTCGACCCCATCCCCATCCACTACTGCGCCCCCGCCG
GCTACGCCATCCTGAAGTGCAACAACAAGACCTTCACCGGCACCGGCCCGTGCAACAACGTGTCCACCGTGCAGTGCAC
GCACGGGATCAAGCCCGTGGTGTCCACGCAGCTGCTCCTGAACGGGTCGCTGGCCGAGGGCGAGATCATCATCCGGTCC
GAGAACATCACGAACAACGCGAAGACCATCATCGTGCACCTGAACGAGTCCGTGAAGATCGAGTGCACCCGCCCGAACA
ACAAGACGCGCACCTCCATCCGGATCGGCCCTGGCCAGGCCTTCTACGCCACCGGCCAGGTGATCGGCGACATCCGCGA
GGCGTACTGCAACATCAGCGAGTCCAAGTGGAACGAGACCCTGCAGCGCGTGTCCAAGAAGCTGAAGGAGTACTTCCCC
CACAAGAACATCACCTTCCAGCCGTCGTCCGGCGGCGACCTCGAGATCACCACGCACTCCTTCAACTGCGGTGGCGAGT
TCTTCTACTGCAACACGTCGTCGCTGTTCAACCGCACCTACATGGCCAACTCCACCGACATGGCCAACTCCACCGAGAC
CAACTCCACGCGCATCATCACGATCCACTGCCGCATCAAGCAGATCATCAACATGTGGCAGGAGGTGGGCCGCGCCATG
TACGCACCGCCCATCGCCGGCAACATCACCTGCATCTCCAACATCACCGGCCTCCTGCTGACCCGCGACGGCGGCAAGA
ACACGAGGGACGGAGGCAAGAACAACACGGAGACCTTCAGGCCAGGCGGAGGCAACATGAAGGACAACTGGCGCTCCGA
GCTGTACAAGTACAAGGTGGTGGAGGTGAAGCCCCTGGGCGTGGCACCCACCAACGCCCGCGAGCGCGTCGTGGAGCGC
GAGAAGGAGTAGTAAGggtcctgaattcggtaaccggatcc

Figure 19A cont.

>HV1300778, CH505.w30.12D8gp120 (SEQ ID NO. 173)
gtcgacaagaagccaccATGCGCGTGATGGGCATCCAGCGCAACTACCCGCAGTGGTGGATCTGGTCGATGCTGGGCTT
CTGGATGCTCATGATCTGCAACGGCGTGCCGGTGTGGAAGGAGGCCAAGACGACCCTGTTCTGCGCGTCGGACGCCAAG
GCCTACGAGAAGGAGGTGCACAACGTGTGGGCGACCCACGCCTGCGTGCCCACGGACCCCAACCCGCAGGAGATGGTGC
TGAAGAACGTGACCGAGAACTTCAACATGTGGAAGAACGACATGGTGGACCAGATGCACGAGGACGTGATCTCCCTGTG
GGACCAGTCCCTGAAGCCCTGCGTGAAGCTGACCCCGCTGTGCGTGACCCTGAACTGCACCAACGCGACCAACGCCACC
GCGTCCAACTCCTCCATCATCGAGGGCATGAAGAACTGCTCCTTCAACATCACGACGGAGCTGCGCGACAAGCGCGAGA
AGAAGAACGCCCTGTTCTACAAGCTGGACATCGTGCAGCTGGACGGCAACTCCTCGCAGTACAGGCTGATCAACTGCAA
CACCTCCGTCATCACGCAGGCGTGCCCCAAGGTGTCCTTCGACCCCATCCCCATCCACTACTGCGCCCCCGCCGGCTAC
GCCATCCTGAAGTGCAACAACAAGACCTTCACCGGCACCGGCCCGTGCAACAACGTGTCCACCGTGCAGTGCACGCACG
GGATCAAGCCCGTGGTGTCCACGCAGCTGCTCCTGAACGGGTCGCTGGCCGAGGGCGAGATCATCATCCGGTCCGAGAA
CATCACGAACAACGACAAGACCATCATCGTGCACCTGAACGAGTCCGTGAAGATCGAGTGCACCCGCCCGAGCAACAAG
ACGCGCACCTCCATCCGGATCGGCCCTGGCCAGGCCTTCTACGCCACCGGCCAGGTGATCGGCGACATCCGCGAGGCGT
ACTGCAACATCAGCGAGTCCAAGTGGAACGAGACCCTGCAGCGCGTGTCCAAGAAGCTGAAGGAGTACTTCCCCCACAA
GAACATCACCTTCCAGCCGTCGTCCGGCGGCGACCTCGAGATCACCACGCACTCCTTCAACTGCGGTGGCGAGTTCTTC
TACTGCAACACGTCGTCGCTGTTCAACCGCACCTACATGGCCAACTCCACCGACATGGCCAACTCCACCGAGACCAACT
CCACGCGCAACATCACGATCCACTGCCGCATCAAGCAGATCATCAACATGTGGCAGGAGGTGGGCCGCGCCATGTACGC
ACCGCCCATCGCCGGCAACATCACCTGCATCTCCAACATCACCGGCCTCCTGCTGACCCGCGACGGCGGCAAGAACGAC
ACGGAGACCTTCAGGCCAGGCGGAGGCAACATGAAGGACAACTGGCGCTCCGAGCTGTACAAGTACAAGGTGGTGGAGG
TGAAGCCCCTGGGCGTGGCACCCACCAACGCCcgcGAgcgcgtcgtggagcgcgagaagGAGTGATAGTAAGaggtccc
ggtaaccggatcc

Figure 19A cont.

>HV1300615, CH505w136.B18D8gp120 (SEQ ID NO. 174)

ggtcgacaagaaGCCACCATGCGCGTGATGGGCCGGCAGCGCAACTACCCGCAGTGGTGGATCTGGTCGATGCTGGGCC
TCTGGATGCTCATGATCTGCAACGGCgtgccggtgTGGAAGGAGGCCAAGACGACCCTGTTCTGCGCGTCGGACGCCAA
GGCCTACGAGAAGGAGGTGCACAACGTGTGGGCGACCCACGCCTGCGTGCCCACGGACCCCAACCCGCAGGAGATGGTG
CTGAAGAACGTGACCGAGAACTTCAACATGTGGAAGAACGACATGGTGGACCAGATGCACGAGGACGTGATCTCCCTGT
GGGACCAGTCCCTGACGCCCTGCGTGAAGCTGACCCCGCTGTGCGTGACCCTGAACTGCACGGACGCCAACGACACCGC
GTCGAACAGCTCCATCATCAAGGGGATGAACAACTCCATCGTGGGGGAGATGAAGAACTGCTCCTTCAACATCACGACG
GAGCTGCGCGACAAGCGCGAGAAGAAGAACGCCCTGTTCTACAAGCTGGACATCGTGCAGCTGGACGGCAACTCCTCGG
AGTACAGGCTGATCAACTGCAACACCTCCGTCATCACGCAGGCGTGCCCCAAGGTGTCCTTCGACCCCATCCCCATCCA
CTACTGCGCCCCCGCCGGCTACGCCATCCTGAAGTGCAACAACAAGACCTTCAACGGCACCGGCCCGTGCAACAACGTG
TCCACCGTGCAGTGCACGCACGGGATCAAGCCCGTGGTGTCCACGCAGCTGCTCCTGAACGGGTCGCTGGCCGAGGGCG
AGATCATCATCCGGTCGGAGAACATCACGGACAACGCGAAGACCATCATCGTGCACCTGAACGAGTCCGTGAAGATCGA
GTGCACCCGCCCGAGCAACAACACGCGCACCTCCATCCGGATCGGCCCTGGCCAGGCCTTCTACGCCACCGGCCAGGTG
ATCGGCGACATCCGCAAGGCGCACTGCAACATCTCCGAGTCCAAGTGGAACGAGACCCTGCAGCGCGTGTCCAAGAAGC
TGAAGGAGTACTTCCCCGACAAGAACATCACCTTCCAGCCGTCGTCCGGCGGCGACCCCGAGATCACCACGCACTCCTT
CAACTGCGGTGGCGAGTTCTTCTACTGCAACACGTCGTCCCTGTTCAACCGCACCTACATGGCCAACTCGACGGACATG
GCGAACTCCGCGGAGACCAACTCCACGCGCACCATCACGCTCCACTGCCGCATCAAGCAGATCATCAACATGTGGCAGG
AGGTGGGCCGCGCCATGTACGCACCGCCCATCGCCGGCAACATCACCTGCATCTCCAACATCACCGGCCTCCTGCTGAC
CCGCGACGGAGGCAACTCCAGCACGGAGACGGAGACCTTCAGGCCAGGGGGAGGCAACATGAAGGACAACTGGCGCTCC
GAGCTGTACAAGTACAAGGTGGTGGAGGTGAAGCCCCTGGGCGTGGCACCCACCAACGCCcgcGAGcgcgtggtggagc
gcgagaagGAGTAGTAAGgtcaccgggacctgaattcggatcc >HV1300531_v2, CH505.M5D8gp120 (SEQ ID NO. 175)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLNCTNATASNSSIIEGMKNCSFNITTELRDKREKKNALFYKL
DIVQLDGNSSQYRLINCNTSVITQACPKVSFDPIPIHYCAPAGYAILKCNNKTFTGTGPCNNVSTVQCTHGIKPVVSTQ
LLLNGSLAEGEIIIRSENITKNVKTIIVHLNESVKIECTRPNNKTRTSIRIGPGQAFYATGQVIGDIREAYCNINESKW
NETLQRVSKKLKEYFPHKNITFQPSSGGDLEITTHSFNCGGEFFYCNTSSLFNRTYMANSTDMANSTETNSTRTITIHC
RIKQIINMWQEVGRAMYAPPIAGNITCISNITGLLLTRDGGKNNTETFRPGGGNMKDNWRSELYKYKVVEVKPLGVAPT
NARERVVEREKE

Figure 19A cont.

>HV1300537_v2, CH505.M11D8gp120 (SEQ ID NO. 176)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLNCTNATASNSSIIEGMKNCSFNITTELRDKREKKNALFYKL
DIVQLDGNSSQYRLINCNTSVITQACPKVSFDPIPIHYCAPAGYAILKCNNKTFTGTGPCNNVSTVQCTHGIKPVVSTQ
LLLNGSLAEGEIIIRSENITDNGKTIIVHLNESVKIECTRPNNKTRTSIRIGPGQAFYATGQVIGDIREAYCNINESKW
NETLQRVSKKLKEYFPHKNITFQPSSGGDLEITTHSFNCGGEFFYCNTSSLFNRTYMANSTDMANSTETNSTRTITIHC
RIKQIINMWQEVGRAMYAPPIAGNITCISNITGLLLTRDGGKNNTETFRPGGGNMKDNWRSELYKYKVVEVKPLGVAPT
NARERVVEREKE

>HV1300556_v2, CH505w020.14D8gp120 (SEQ ID NO. 177)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLNCTNATASNNSIIEGMKNCSFNITTELRDKREKKNALFYKL
DIVQLDGNSSQYRLINCNTSVITQACPKVSFDPIPIHYCAPAGYAILKCNNKTFTGTGPCNNVSTVQCTHGIKPVVSTQ
LLLNGSLAEGEIIIRSENITNNAKTIIVHLNESVKIECTRPNNKTRTSIRIGPGQAFYATGQVIGDIRKAYCNISESKW
NETLQRVSKKLKEYFPHKNITFQPSSGGDLEITTHSFNCGGEFFYCNTSSLFNRTYMANSTDMANSTETNSTRTITLHC
RIKQIINMWQEVGRAMYAPPIAGNITCISNITGLLLTRDGGKNNTETFRPGGGNMKDNWRSELYKYKVVEVKPLGVAPT
NARERVVEREKE

>HV1300573_v2, CH505w030.20D8gp120 (SEQ ID NO. 178)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLNCTNATTNATASNSSIIEGMKNCSFNITTELRDKREKKNAL
FYKLDIVQLDGNSSQYRLINCNTSVITQACPKVSFDPIPIHYCAPAGYAILKCNNKTFTGTGPCNNVSTVQCTHGIKPV
VSTQLLLNGSLAEGEIIIRSENITNNAKTIIVHLNESVKIECTRPNNKTRTSIRIGPGQAFYATGQVIGDIREAYCNIS
ESKWNETLQRVSKKLKEYFPHKNITFQPSSGGDLEITTHSFNCGGEFFYCNTSSLFNRTYMANSTDMANSTETNSTRII
TIHCRIKQIINMWQEVGRAMYAPPIAGNITCISNITGLLLTRDGGKNTRDGGKNNTETFRPGGGNMKDNWRSELYKYKV
VEVKPLGVAPTNARERVVEREKE

>HV1300778, CH505.w30.12D8gp120 (SEQ ID NO. 179)

MRVMGIQRNYPQWWIWSMLGFWMLMICNGVPVWKEAKTTLFCASDAKAYEKEVHNVWATHACVPTDPNPQEMVLKNVTE
NFNMWKNDMVDQMHEDVISLWDQSLKPCVKLTPLCVTLNCTNATNATASNSSIIEGMKNCSFNITTELRDKREKKNALF
YKLDIVQLDGNSSQYRLINCNTSVITQACPKVSFDPIPIHYCAPAGYAILKCNNKTFTGTGPCNNVSTVQCTHGIKPVV
STQLLLNGSLAEGEIIIRSENITNNDKTIIVHLNESVKIECTRPSNKTRTSIRIGPGQAFYATGQVIGDIREAYCNISE
SKWNETLQRVSKKLKEYFPHKNITFQPSSGGDLEITTHSFNCGGEFFYCNTSSLFNRTYMANSTDMANSTETNSTRNIT
IHCRIKQIINMWQEVGRAMYAPPIAGNITCISNITGLLLTRDGGKNDTETFRPGGGNMKDNWRSELYKYKVVEVKPLGV
APTNARERVVEREKE

Figure 19A cont.

>HV1300615, CH505w136.B18D8gp120 (SEQ ID NO. 180)
MRVMGRQRNYPQWWIWSMLGLWMLMICNGVPVWKEAKTTLFCASDAKAYEKEVHNVWATHACVPTDPNPQEMVLKNVTE
NFNMWKNDMVDQMHEDVISLWDQSLTPCVKLTPLCVTLNCTDANDTASNSSIIKGMNNSIVGEMKNCSFNITTELRDKR
EKKNALFYKLDIVQLDGNSSEYRLINCNTSVITQACPKVSFDPIPIHYCAPAGYAILKCNNKTFNGTGPCNNVSTVQCT
HGIKPVVSTQLLLNGSLAEGEIIIRSENITDNAKTIIVHLNESVKIECTRPSNNTRTSIRIGPGQAFYATGQVIGDIRK
AHCNISESKWNETLQRVSKKLKEYFPDKNITFQPSSGGDPEITTHSFNCGGEFFYCNTSSLFNRTYMANSTDMANSAET
NSTRTITLHCRIKQIINMWQEVGRAMYAPPIAGNITCISNITGLLLTRDGGNSSTETETFRPGGGNMKDNWRSELYKYK
VVEVKPLGVAPTNARERVVEREKE

Gp145 constructs
>HV1300656, CH505.M5gp145 (SEQ ID NO. 181)
gtcgacaagaaGCCACCATGCGCGTGATGGGCATCCAGCGCAACTACCCGCAGTGGTGGATCTGGTCGATGCTGGGCTT
CTGGATGCTCATGATCTGCAACGGCATGTGGGTGACGGTGTACTACGGCgtgccggtgTGGAAGGAGGCCAAGACGACC
CTGTTCTGCGCGTCGGACGCCAAGGCCTACGAGAAGGAGGTGCACAACGTGTGGGCGACCCACGCCTGCGTGCCCACGG
ACCCCAACCCGCAGGAGATGGTGCTGAAGAACGTGACCGAGAACTTCAACATGTGGAAGAACGACATGGTGGACCAGAT
GCACGAGGACGTGATCTCCCTGTGGGACCAGTCCCTGAAGCCCTGCGTGAAGCTGACCCCGCTGTGCGTGACCCTGAAC
TGCACCAACGCCACCGCGTCCAACTCCTCCATCATCGAGGGCATGAAGAACTGCTCCTTCAACATCACGACGGAGCTGC
GCGACAAGCGCGAGAAGAAGAACGCCCTGTTCTACAAGCTGGACATCGTGCAGCTGGACGGCAACTCCTCGCAGTACAG
GCTGATCAACTGCAACACCTCCGTCATCACGCAGGCGTGCCCCAAGGTGTCCTTCGACCCCATCCCCATCCACTACTGC
GCCCCCGCCGGCTACGCCATCCTGAAGTGCAACAACAAGACCTTCACCGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCAT
CATCCGGTCCGAGAACATCACGAAGAACGTGAAGACCATCATCGTGCACCTGAACGAGTCCGTGAAGATCGAGTGCACC
CGCCCGAACAACAAGACGCGCACCTCCATCCGGATCGGCCCTGGCCAGGCCTTCTACGCCACCGGCCAGGTGATCGGCG
ACATCCGCGAGGCGTACTGCAACATCAACGAGTCCAAGTGGAACGAGACCCTGCAGCGCGTGTCCAAGAAGCTGAAGGA
GTACTTCCCCCACAAGAACATCACCTTCCAGCCGTCGTCCGGCGGCGACCTCGAGATCACCACGCACTCCTTCAACTGC
GGTGGCGAGTTCTTCTACTGCAACACGTCGTCGCTGTTCAACCGCACCTACATGGCCAACTCCACCGACATGGCCAACT
CCACCGAGACCAACTCCACGCGCACCATCACGATCCACTGCCGCATCAAGCAGATCATCAACATGTGGCAGGAGGTGGG
CCGCGCCATGTACGCACCGCCCATCGCCGGCAACATCACCTGCATCTCCAACATCACCGGCCTCCTGCTGACCCGCGAC
GGCGGCAAGAACAACACGGAGACCTTCAGGCCAGGCGGAGGCAACATGAAGGACAACTGGCGCTCCGAGCTGTACAAGT
ACAAGGTGGTGGAGGTGAAGCCCCTGGGCGTGGCACCCACCAACGCCcgcaggcgcgtcgtggagcgcgagaagcgcGC
CGTGGGCATGGGCGCCGTGTTCCTGGGCTTCCTGGGCGCTGCGGGCTCCACCATGGGTGCCGCGTCCATCACCCTGACC
GTGCAGGCCCGCCAGCTGCTCTCCGGCATCGTGCAGCAGCAGTCCAACCTCCTGAAGGCCATCGAGGCCCAGCAGCACA
TGCTGAAGCTGACCGTGTGGGGCATCAAGCAGCTGCAGGCCAGGGTGCTCGCGCTCGAGCGCTACCTGAAGGACCAGCA
GCTGCTCGGCATGTGGGGCTGCTCCGGCAAGCTGATCTGCACCACCAACGTGTACTGGAACTCGTCCTGGTCCAACAAG
ACCTACGGCGACATCTGGGACAACATGACCTGGATGCAGTGGGAGCGCGAGATCTCCAACTACACCGAGATCATCTACG
AGCTCCTCGAGGAGTCCCAGAACCAGCAGGAGAAGAACGAGCAGGATCTGCTCGCGCTGGACCGCTGGAACTCCCTGTG
GAACTGGTTCAACATCACCAACTGGCTGTGGTACATCAAGATCTTCATCATGATCGTGGGCGGCCTGATCGGCCTGCGC
ATCATCTTCGCCGTGCTGTCGCTGGTGAACCGCGTGCGCCAGGGCTGATGAGgtgaccgaattcgggacccggatcc

Figure 19A cont.

>HV1300662, CH505.M11gp145 (SEQ ID NO. 182)

gtcgacaagaaGCCACCATGCGCGTGATGGGCATCCAGCGCAACTACCCGCAGTGGTGGATCTGGTCGATGCTGGGCTT
CTGGATGCTCATGATCTGCAACGGCATGTGGGTGACGGTGTACTACGGCgtgccggtgTGGAAGGAGGCCAAGACGACC
CTGTTCTGCGCGTCGGACGCCAAGGCCTACGAGAAGGAGGTGCACAACGTGTGGGCGACCCACGCCTGCGTGCCCACGG
ACCCCAACCCGCAGGAGATGGTGCTGAAGAACGTGACCGAGAACTTCAACATGTGGAAGAACGACATGGTGGACCAGAT
GCACGAGGACGTGATCTCCCTGTGGGACCAGTCCCTGAAGCCCTGCGTGAAGCTGACCCCGCTGTGCGTGACCCTGAAC
TGCACCAACGCCACCGCGTCCAACTCCTCCATCATCGAGGGCATGAAGAACTGCTCCTTCAACATCACGACGGAGCTGC
GCGACAAGCGCGAGAAGAAGAACGCCCTGTTCTACAAGCTGGACATCGTGCAGCTGGACGGCAACTCCTCGCAGTACAG
GCTGATCAACTGCAACACCTCCGTCATCACGCAGGCGTGCCCCAAGGTGTCCTTCGACCCCATCCCCATCCACTACTGC
GCCCCCGCCGGCTACGCCATCCTGAAGTGCAACAACAAGACCTTCACCGGCACCGGCCCGTGCAACAACGTGTCCACCG
TGCAGTGCACGCACGGGATCAAGCCCGTGGTGTCCACGCAGCTGCTCCTGAACGGGTCGCTGGCCGAGGGCGAGATCAT
CATCCGGTCCGAGAACATCACGGACAACGGGAAGACCATCATCGTGCACCTGAACGAGTCCGTGAAGATCGAGTGCACC
CGCCCGAACAACAAGACGCGCACCTCCATCCGGATCGGCCCTGGCCAGGCCTTCTACGCCACCGGCCAGGTGATCGGCG
ACATCCGCGAGGCGTACTGCAACATCAACGAGTCCAAGTGGAACGAGACCCTGCAGCGCGTGTCCAAGAAGCTGAAGGA
GTACTTCCCCCACAAGAACATCACCTTCCAGCCGTCGTCCGGCGGCGACCTCGAGATCACCACGCACTCCTTCAACTGC
GGTGGCGAGTTCTTCTACTGCAACACGTCGTCGCTGTTCAACCGCACCTACATGGCCAACTCCACCGACATGGCCAACT
CCACCGAGACCAACTCCACGCGCACCATCACGATCCACTGCCGCATCAAGCAGATCATCAACATGTGGCAGGAGGTGGG
CCGCGCCATGTACGCACCGCCCATCGCCGGCAACATCACCTGCATCTCCAACATCACCGGCCTCCTGCTGACCCGCGAC
GGCGGCAAGAACAACACGGAGACCTTCAGGCCAGGCGGAGGCAACATGAAGGACAACTGGCGCTCCGAGCTGTACAAGT
ACAAGGTGGTGGAGGTGAAGCCCCTGGGCGTGGCACCCACCAACGCCcgcaggcgcgtcgtggagcgcgagaagcgcGC
CGTGGGCATGGGCGCCGTGTTCCTGGGCTTCCTGGGCGCTGCGGGCTCCACCATGGGTGCCGCGTCCATCACCCTGACC
GTGCAGGCCCGCCAGCTGCTCTCCGGCATCGTGCAGCAGCAGTCCAACCTCCTGAAGGCCATCGAGGCCCAGCAGCACA
TGCTGAAGCTGACCGTGTGGGGCATCAAGCAGCTGCAGGCCAGGGTGCTCGCGCTCGAGCGCTACCTGAAGGACCAGCA
GCTGCTCGGCATGTGGGGCTGCTCCGGCAAGCTGATCTGCACCACCAACGTGTACTGGAACTCGTCCTGGTCCAACAAG
ACCTACGGCGACATCTGGGACAACATGACCTGGATGCAGTGGGAGCGCGAGATCTCCAACTACACCGAGATCATCTACG
AGCTCCTCGAGGAGTCCCAGAACCAGCAGGAGAAGAACGAGCAGGATCTGCTCGCGCTGGACCGCTGGAACTCCCTGTG
GAACTGGTTCAACATCACCAACTGGCTGTGGTACATCAAGATCTTCATCATGATCGTGGGCGGCCTGATCGGCCTGCGC
ATCATCTTCGCCGTGCTGTCGCTGGTGAACCGCGTGCGCCAGGGCTGATGAGgtgaccgaattcaggtcccggatcc

Figure 19A cont.

>HV1300635,CH505w020.14gp145 (SEQ ID NO. 183)

gtcgacaagaaATGCGCGTGATGGGCATCCAGCGCAACTACCCGCAGTGGTGGATCTGGTCGATGCTGGGCTTCTGGAT
GCTCATGATCTGCAACGGCATGTGGGTGACGGTGTACTACGGCgtgccggtgTGGAAGGAGGCCAAGACGACCCTGTTC
TGCGCGTCGGACGCCAAGGCCTACGAGAAGGAGGTGCACAACGTGTGGGCGACCCACGCCTGCGTGCCCACGGACCCCA
ACCCGCAGGAGATGGTGCTGAAGAACGTGACCGAGAACTTCAACATGTGGAAGAACGACATGGTGGACCAGATGCACGA
GGACGTGATCTCCCTGTGGGACCAGTCCCTGAAGCCCTGCGTGAAGCTGACCCCGCTGTGCGTGACCCTGAACTGCACC
AACGCCACCGCGTCCAACAACTCCATCATCGAGGGCATGAAGAACTGCTCCTTCAACATCACGACGGAGCTGCGCGACA
AGCGCGAGAAGAAGAACGCCCTGTTCTACAAGCTGGACATCGTGCAGCTGGACGGCAACTCCTCGCAGTACAGGCTGAT
CAACTGCAACACCTCCGTCATCACGCAGGCGTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCGTGCAACAACGTGTCCACCGTGCAGT
GCACGCACGGGATCAAGCCCGTGGTGTCCACGCAGCTGCTCCTGAACGGGTCGCTGGCCGAGGGCGAGATCATCATCCG
GTCCGAGAACATCACGAACAACGCGAAGACCATCATCGTGCACCTGAACGAGTCCGTGAAGATCGAGTGCACCCGCCCG
AACAACAAGACGCGCACGTCCATCCGGATCGGCCCTGGCCAGGCCTTCTACGCCACCGGCCAGGTGATCGGCGACATCC
GCAAGGCGTACTGCAACATCTCGGAGTCCAAGTGGAACGAGACCCTGCAGCGCGTGTCCAAGAAGCTGAAGGAGTACTT
CCCCCACAAGAACATCACCTTCCAGCCGTCGTCCGGCGGCGACCTCGAGATCACCACGCACTCCTTCAACTGCGGTGGC
GAGTTCTTCTACTGCAACACGTCGTCGCTGTTCAACCGCACCTACATGGCCAACTCCACCGACATGGCCAACTCCACCG
AGACCAACTCCACGCGCACCATCACGCTCCACTGCCGCATCAAGCAGATCATCAACATGTGGCAGGAGGTGGGCCGCGC
CATGTACGCACCGCCCATCGCCGGCAACATCACCTGCATCTCCAACATCACCGGCCTCCTGCTGACCCGCGACGGCGGC
AAGAACAACACGGAGACCTTCAGGCCAGGCGGAGGCAACATGAAGGACAACTGGCGCTCCGAGCTGTACAAGTACAAGG
TGGTGGAGGTGAAGCCCCTGGGCGTGGCACCCACCAACGCCcgcaggcgcgtcgtggagcgcgagaagcgcGCCGTGGG
CATGGGCGCCGTGTTCCTGGGCTTCCTGGGCGCTGCGGGCTCCACCATGGGTGCCGCGTCCATCACCCTGACCGTGCAG
GCCCGCCAGCTGCTCTCCGGCATCGTGCAGCAGCAGTCCAACCTCCTGAAGGCCATCGAGGCCCAGCAGCACATGCTGA
AGCTGACCGTGTGGGGCATCAAGCAGCTGCAGGCCAGGGTGCTCGCGCTCGAGCGCTACCTGAAGGACCAGCAGCTGCT
CGGCATGTGGGGCTGCTCCGGCAAGCTGATCTGCACCACCAACGTGTACTGGAACTCGTCCTGGTCCAACAAGACCTAC
GGCGACATCTGGGACAACATGACCTGGATGCAGTGGGAGCGCGAGATCTCCAACTACACCGAGATCATCTACGAGCTCC
TCGAGGAGTCCCAGAACCAGCAGGAGAAGAACGAGCAGGATCTGCTCGCGCTGGACCGCTGGAACTCCCTGTGGAACTG
GTTCAACATCACCAACTGGCTGTGGTACATCAAGATCTTCATCATGATCGTGGGCGGCCTGATCGGCCTGCGCATCATC
TTCGCCGTGCTGTCGCTGGTGAACCGCGTGCGCCAGGGCTGATGAGggacccgaattcggtcaccggatcc

Figure 19A cont.

>HV1300688, CH505w30.20gp145 (SEQ ID NO. 184)

gtcgacaagaaGCCACCATGCGCGTGATGGGCATCCAGCGCAACTACCCGCAGTGGTGGATCTGGTCGATGCTGGGCTT
CTGGATGCTCATGATCTGCAACGGCATGTGGGTGACGGTGTACTACGGCgtgccggtgTGGAAGGAGGCCAAGACGACC
CTGTTCTGCGCGTCGGACGCCAAGGCCTACGAGAAGGAGGTGCACAACGTGTGGGCGACCCACGCCTGCGTGCCCACGG
ACCCCAACCCGCAGGAGATGGTGCTGAAGAACGTGACCGAGAACTTCAACATGTGGAAGAACGACATGGTGGACCAGAT
GCACGAGGACGTGATCTCCCTGTGGGACCAGTCCCTGAAGCCCTGCGTGAAGCTGACCCCGCTGTGCGTGACCCTGAAC
TGCACCAACGCGACGACCAACGCCACCGCGTCCAACTCCTCCATCATCGAGGGCATGAAGAACTGCTCCTTCAACATCA
CGACGGAGCTGCGCGACAAGCGCGAGAAGAAGAACGCCCTGTTCTACAAGCTGGACATCGTGCAGCTGGACGGCAACTC
CTCGCAGTACAGGCTGATCAACTGCAACACCTCCGTCATCACGCAGGCGTGCCCCAAGGTGTCCTTCGACCCCATCCCC
ATCCACTACTGCGCCCCCGCCGGCTACGCCATCCTGAAGTGCAACAACAAGACCTTCACCGGCACCGGCCCGTGCAACA
ACGTGTCCACCGTGCAGTGCACGCACGGGATCAAGCCCGTGGTGTCCACGCAGCTGCTCCTGAACGGGTCGCTGGCCGA
GGGCGAGATCATCATCCGGTCCGAGAACATCACGAACAACGCGAAGACCATCATCGTGCACCTGAACGAGTCCGTGAAG
ATCGAGTGCACCCGCCCGAACAACAAGACGCGCACCTCCATCCGGATCGGCCCTGGCCAGGCCTTCTACGCCACCGGCC
AGGTGATCGGCGACATCCGCGAGGCGTACTGCAACATCAGCGAGTCCAAGTGGAACGAGACCCTGCAGCGCGTGTCCAA
GAAGCTGAAGGAGTACTTCCCCCACAAGAACATCACCTTCCAGCCGTCGTCCGGCGGCGACCTCGAGATCACCACGCAC
TCCTTCAACTGCGGTGGCGAGTTCTTCTACTGCAACACGTCGTCGCTGTTCAACCGCACCTACATGGCCAACTCCACCG
ACATGGCCAACTCCACCGAGACCAACTCCACGCGCATCATCACGATCCACTGCCGCATCAAGCAGATCATCAACATGTG
GCAGGAGGTGGGCCGCGCCATGTACGCACCGCCCATCGCCGGCAACATCACCTGCATCTCCAACATCACCGGCCTCCTG
CTGACCCGCGACGGCGGCAAGAACACGAGGGACGGAGGCAAGAACAACACGGAGACCTTCAGGCCAGGCGGAGGCAACA
TGAAGGACAACTGGCGCTCCGAGCTGTACAAGTACAAGGTGGTGGAGGTGAAGCCCCTGGGCGTGGCACCCACCAACGC
CcgcaggcgcgtcgtggagcgcgagaagcgcGCCGTGGGCATGGGCGCCGTGTTCCTGGGCTTCCTGGGCGCTGCGGGC
TCCACCATGGGTGCCGCGTCCATCACCCTGACCGTGCAGGCCCGCCAGCTGCTCTCCGGCATCGTGCAGCAGCAGTCCA
ACCTCCTGAAGGCCATCGAGGCCCAGCAGCACATGCTGAAGCTGACCGTGTGGGGCATCAAGCAGCTGCAGGCCAGGGT
GCTCGCGCTCGAGCGCTACCTGAAGGACCAGCAGCTGCTCGGCATGTGGGGCTGCTCCGGCAAGCTGATCTGCACCACC
AACGTGTACTGGAACTCGTCCTGGTCCAACAAGACCTACGGCGACATCTGGGACAACATGACCTGGATGCAGTGGGAGC
GCGAGATCTCCAACTACACCGAGATCATCTACGAGCTCCTCGAGGAGTCCCAGAACCAGCAGGAGAAGAACGAGCAGGA
TCTGCTCGCGCTGGACCGCTGGAACTCCCTGTGGAACTGGTTCAACATCACCAACTGGCTGTGGTACATCAAGATCTTC
ATCATGATCGTGGGCGGCCTGATCGGCCTGCGCATCATCTTCGCCGTGCTGTCGCTGGTGAACCGCGTGCGCCAGGGCT
GATGAGggtcctgaattcggtaaccggatcc

Figure 19A cont.

>HV1300646, CH505.w30.12gp145 (SEQ ID NO. 185)

gtcgacaagaaATGCGCGTGATGGGCATCCAGCGCAACTACCCGCAGTGGTGGATCTGGTCGATGCTGGGCTTCTGGAT
GCTCATGATCTGCAACGGCATGTGGGTGACGGTGTACTACGGCgtgccggtgTGGAAGGAGGCCAAGACGACCCTGTTC
TGCGCGTCGGACGCCAAGGCCTACGAGAAGGAGGTGCACAACGTGTGGGCGACCCACGCCTGCGTGCCCACGGACCCCA
ACCCGCAGGAGATGGTGCTGAAGAACGTGACCGAGAACTTCAACATGTGGAAGAACGACATGGTGGACCAGATGCACGA
GGACGTGATCTCCCTGTGGGACCAGTCCCTGAAGCCCTGCGTGAAGCTGACCCCGCTGTGCGTGACCCTGAACTGCACC
AACGCGACCAACGCCACCGCGTCCAACTCCTCCATCATCGAGGGCATGAAGAACTGCTCCTTCAACATCACGACGGAGC
TGCGCGACAAGCGCGAGAAGAAGAACGCCCTGTTCTACAAGCTGGACATCGTGCAGCTGGACGGCAACTCCTCGCAGTA
CAGGCTGATCAACTGCAACACCTCCGTCATCACGCAGGCGTGCCCCAAGGTGTCCTTCGACCCCATCCCCATCCACTAC
TGCGCCCCCGCCGGCTACGCCATCCTGAAGTGCAACAACAAGACCTTCACCGGCACCGGCCCGTGCAACAACGTGTCCA
CCGTGCAGTGCACGCACGGGATCAAGCCCGTGGTGTCCACGCAGCTGCTCCTGAACGGGTCGCTGGCCGAGGGCGAGAT
CATCATCCGGTCCGAGAACATCACGAACAACGACAAGACCATCATCGTGCACCTGAACGAGTCCGTGAAGATCGAGTGC
ACCCGCCCGAGCAACAAGACGCGCACCTCCATCCGGATCGGCCCTGGCCAGGCCTTCTACGCCACCGGCCAGGTGATCG
GCGACATCCGCGAGGCGTACTGCAACATCAGCGAGTCCAAGTGGAACGAGACCCTGCAGCGCGTGTCCAAGAAGCTGAA
GGAGTACTTCCCCCACAAGAACATCACCTTCCAGCCGTCGTCCGGCGGCGACCTCGAGATCACCACGCACTCCTTCAAC
TGCGGTGGCGAGTTCTTCTACTGCAACACGTCGTCGCTGTTCAACCGCACCTACATGGCCAACTCCACCGACATGGCCA
ACTCCACCGAGACCAACTCCACGCGCAACATCACGATCCACTGCCGCATCAAGCAGATCATCAACATGTGGCAGGAGGT
GGGCCGCGCCATGTACGCACCGCCCATCGCCGGCAACATCACCTGCATCTCCAACATCACCGGCCTCCTGCTGACCCGC
GACGGCGGCAAGAACGACACGGAGACCTTCAGGCCAGGCGGAGGCAACATGAAGGACAACTGGCGCTCCGAGCTGTACA
AGTACAAGGTGGTGGAGGTGAAGCCCCTGGGCGTGGCACCCACCAACGCCcgcaggcgcgtcgtggagcgcgagaagcg
cGCCGTGGGCATGGGCGCCGTGTTCCTGGGCTTCCTGGGCGCTGCGGGCTCCACCATGGGTGCCGCGTCCATCACCCTG
ACCGTGCAGGCCCGCCAGCTGCTCTCCGGCATCGTGCAGCAGCAGTCCAACCTCCTGAAGGCCATCGAGGCCCAGCAGC
ACATGCTGAAGCTGACCGTGTGGGGCATCAAGCAGCTGCAGGCCAGGGTGCTCGCGCTCGAGCGCTACCTGAAGGACCA
GCAGCTGCTCGGCATGTGGGGCTGCTCCGGCAAGCTGATCTGCACCACCAACGTGTACTGGAACTCGTCCTGGTCCAAC
AAGACCTACGGCGACATCTGGGACAACATGACCTGGATGCAGTGGGAGCGCGAGATCTCCAACTACACCGAGATCATCT
ACGAGCTCCTCGAGGAGTCCCAGAACCAGCAGGAGAAGAACGAGCAGGATCTGCTCGCGCTGGACCGCTGGAACTCCCT
GTGGAACTGGTTCAACATCACCAACTGGCTGTGGTACATCAAGATCTTCATCATGATCGTGGGCGGCCTGATCGGCCTG
CGCATCATCTTCGCCGTGCTGTCGCTGGTGAACCGCGTGCGCCAGGGCTGATGAggtcccggtaaccggatcc

Figure 19A cont.

>HV1300724, CH505w136.B18gp145 (SEQ ID NO. 186)

GgtcgacaagaaGCCACCATGCGCGTGATGGGCCGGCAGCGCAACTACCCGCAGTGGTGGATCTGGTCGATGCTGGGCC
TCTGGATGCTCATGATCTGCAACGGCATGTGGGTGACGGTGTACTACGGCgtgccggtgTGGAAGGAGGCCAAGACGAC
CCTGTTCTGCGCGTCGGACGCCAAGGCCTACGAGAAGGAGGTGCACAACGTGTGGGCGACCCACGCCTGCGTGCCCACG
GACCCCAACCCGCAGGAGATGGTGCTGAAGAACGTGACCGAGAACTTCAACATGTGGAAGAACGACATGGTGGACCAGA
TGCACGAGGACGTGATCTCCCTGTGGGACCAGTCCCTGACGCCCTGCGTGAAGCTGACCCCGCTGTGCGTGACCCTGAA
CTGCACGGACGCCAACGACACCGCGTCGAACAGCTCCATCATCAAGGGGATGAACAACTCCATCGTGGGGGAGATGAAG
AACTGCTCCTTCAACATCACGACGGAGCTGCGCGACAAGCGCGAGAAGAAGAACGCCCTGTTCTACAAGCTGGACATCG
TGCAGCTGGACGGCAACTCCTCGGAGTACAGGCTGATCAACTGCAACACCTCCGTCATCACGCAGGCGTGCCCCAAGGT
GTCCTTCGACCCCATCCCCATCCACTACTGCGCCCCCGCCGGCTACGCCATCCTGAAGTGCAACAACAAGACCTTCAAC
GGCACCGGCCCGTGCAACAACGTGTCCACCGTGCAGTGCACGCACGGGATCAAGCCCGTGGTGTCCACGCAGCTGCTCC
TGAACGGGTCGCTGGCCGAGGGCGAGATCATCATCCGGTCGGAGAACATCACGGACAACGCGAAGACCATCATCGTGCA
CCTGAACGAGTCCGTGAAGATCGAGTGCACCCGCCCGAGCAACAACACGCGCACCTCCATCCGGATCGGCCCTGGCCAG
GCCTTCTACGCCACCGGCCAGGTGATCGGCGACATCCGCAAGGCGCACTGCAACATCTCCGAGTCCAAGTGGAACGAGA
CCCTGCAGCGCGTGTCCAAGAAGCTGAAGGAGTACTTCCCCGACAAGAACATCACCTTCCAGCCGTCGTCCGGCGGCGA
CCCCGAGATCACCACGCACTCCTTCAACTGCGGTGGCGAGTTCTTCTACTGCAACACGTCGTCCCTGTTCAACCGCACC
TACATGGCCAACTCGACGGACATGGCGAACTCCGCGGAGACCAACTCCACGCGCACCATCACGCTCCACTGCCGCATCA
AGCAGATCATCAACATGTGGCAGGAGGTGGGCCGCGCCATGTACGCACCGCCCATCGCCGGCAACATCACCTGCATCTC
CAACATCACCGGCCTCCTGCTGACCCGCGACGGAGGCAACTCCAGCACGGAGACGGAGACCTTCAGGCCAGGGGGAGGC
AACATGAAGGACAACTGGCGCTCCGAGCTGTACAAGTACAAGGTGGTGGAGGTGAAGCCCCTGGGCGTGGCACCCACCA
ACGCCCGCAGGCGCGTGGTGGAGCGCGAGAAGCGCGCCGTGGGCATGGGCGCCGTGTTCCTGGGCTTCCTGGGCGCTGC
GGGCTCCACCATGGGTGCCGCGTCCATCACCCTGACCGTGCAGGCCCGCCAGCTGCTCTCCGGCATCGTGCAGCAGCAG
TCCAACCTCCTGAAGGCCATCGAGGCCCAGCAGCACATGCTGCGGCTGACCGTGTGGGGCATCAAGCAGCTGCAGGCCA
GGGTGCTCGCGCTCGAGCGCTACCTGAAGGACCAGCAGCTGCTCGGCATGTGGGGCTGCTCCGGCAAGCTGATCTGCAC
CACCAACGTGTACTGGAACTCGTCCTGGTCCAACAAGACCTACGACGACATCTGGGACAACATGACCTGGATGCAGTGG
GAGGGGGAGATCTCCAACTACACCAACATCATCTACGACCTCCTCGAGGAGTCCCAGAACCAGCAGGAGAAGAACGAGC
AGGATCTGCTCGCGCTGGACCGCTGGAACTCCCTGTGGAACTGGTTCAACATCACCAACTGGCTGTGGTACATCAAGAT
CTTCATCATGATCGTGGGCGGCCTGATCGGCCTGCGGATCATCTTCGCCGTGCTGTCGCTGGTGAACCGCGTGCGCCAG
GGCTGATGAGctcaccgggacctgaattcggatcc

Figure 19A cont.

>HV1300656, CH505.M5gp145, (SEQ ID NO. 187)
MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKLTPLCVTLNCTNATASNSSIIEGMKNCSFNITTELRDKREK
KNALFYKLDIVQLDGNSSQYRLINCNTSVITQACPKVSFDPIPIHYCAPAGYAILKCNNKTFTGTGPCNNVSTVQCTHG
IKPVVSTQLLLNGSLAEGEIIIRSENITKNVKTIIVHLNESVKIECTRPNNKTRTSIRIGPGQAFYATGQVIGDIREAY
CNINESKWNETLQRVSKKLKEYFPHKNITFQPSSGGDLEITTHSFNCGGEFFYCNTSSLFNRTYMANSTDMANSTETNS
TRTITIHCRIKQIINMWQEVGRAMYAPPIAGNITCISNITGLLLTRDGGKNNTETFRPGGGNMKDNWRSELYKYKVVEV
KPLGVAPTNARRRVVEREKRAVGMGAVFLGFLGAAGSTMGAASITLTVQARQLLSGIVQQQSNLLKAIEAQQHMLKLTV
WGIKQLQARVLALERYLKDQQLLGMWGCSGKLICTTNVYWNSSWSNKTYGDIWDNMTWMQWEREISNYTEIIYELLEES
QNQQEKNEQDLLALDRWNSLWNWFNITNWLWYIKIFIMIVGGLIGLRIIFAVLSLVNRVRQG*

>HV1300662, CH505.M11gp145, (SEQ ID NO. 188)
MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKLTPLCVTLNCTNATASNSSIIEGMKNCSFNITTELRDKREK
KNALFYKLDIVQLDGNSSQYRLINCNTSVITQACPKVSFDPIPIHYCAPAGYAILKCNNKTFTGTGPCNNVSTVQCTHG
IKPVVSTQLLLNGSLAEGEIIIRSENITDNGKTIIVHLNESVKIECTRPNNKTRTSIRIGPGQAFYATGQVIGDIREAY
CNINESKWNETLQRVSKKLKEYFPHKNITFQPSSGGDLEITTHSFNCGGEFFYCNTSSLFNRTYMANSTDMANSTETNS
TRTITIHCRIKQIINMWQEVGRAMYAPPIAGNITCISNITGLLLTRDGGKNNTETFRPGGGNMKDNWRSELYKYKVVEV
KPLGVAPTNARRRVVEREKRAVGMGAVFLGFLGAAGSTMGAASITLTVQARQLLSGIVQQQSNLLKAIEAQQHMLKLTV
WGIKQLQARVLALERYLKDQQLLGMWGCSGKLICTTNVYWNSSWSNKTYGDIWDNMTWMQWEREISNYTEIIYELLEES
QNQQEKNEQDLLALDRWNSLWNWFNITNWLWYIKIFIMIVGGLIGLRIIFAVLSLVNRVRQG*

>HV1300635, CH505w020.14gp145, (SEQ ID NO. 189)
MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKLTPLCVTLNCTNATASNNSIIEGMKNCSFNITTELRDKREK
KNALFYKLDIVQLDGNSSQYRLINCNTSVITQACPKVSFDPIPIHYCAPAGYAILKCNNKTFTGTGPCNNVSTVQCTHG
IKPVVSTQLLLNGSLAEGEIIIRSENITNNAKTIIVHLNESVKIECTRPNNKTRTSIRIGPGQAFYATGQVIGDIRKAY
CNISESKWNETLQRVSKKLKEYFPHKNITFQPSSGGDLEITTHSFNCGGEFFYCNTSSLFNRTYMANSTDMANSTETNS
TRTITLHCRIKQIINMWQEVGRAMYAPPIAGNITCISNITGLLLTRDGGKNNTETFRPGGGNMKDNWRSELYKYKVVEV
KPLGVAPTNARRRVVEREKRAVGMGAVFLGFLGAAGSTMGAASITLTVQARQLLSGIVQQQSNLLKAIEAQQHMLKLTV
WGIKQLQARVLALERYLKDQQLLGMWGCSGKLICTTNVYWNSSWSNKTYGDIWDNMTWMQWEREISNYTEIIYELLEES
QNQQEKNEQDLLALDRWNSLWNWFNITNWLWYIKIFIMIVGGLIGLRIIFAVLSLVNRVRQG*

Figure 19A cont.

>HV1300688, CH505w30.20gp145, (SEQ ID NO. 190)

MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKLTPLCVTLNCTNATTNATASNSSIIEGMKNCSFNITTELRD
KREKKNALFYKLDIVQLDGNSSQYRLINCNTSVITQACPKVSFDPIPIHYCAPAGYAILKCNNKTFTGTGPCNNVSTVQ
CTHGIKPVVSTQLLLNGSLAEGEIIIRSENITNNAKTIIVHLNESVKIECTRPNNKTRTSIRIGPGQAFYATGQVIGDI
REAYCNISESKWNETLQRVSKKLKEYFPHKNITFQPSSGGDLEITTHSFNCGGEFFYCNTSSLFNRTYMANSTDMANST
ETNSTRIITIHCRIKQIINMWQEVGRAMYAPPIAGNITCISNITGLLLTRDGGKNTRDGGKNNTETFRPGGGNMKDNWR
SELYKYKVVEVKPLGVAPTNARRRVVEREKRAVGMGAVFLGFLGAAGSTMGAASITLTVQARQLLSGIVQQQSNLLKAI
EAQQHMLKLTVWGIKQLQARVLALERYLKDQQLLGMWGCSGKLICTTNVYWNSSWSNKTYGDIWDNMTWMQWEREISNY
TEIIYELLEESQNQQEKNEQDLLALDRWNSLWNWFNITNWLWYIKIFIMIVGGLIGLRIIFAVLSLVNRVRQG*

>HV1300646, CH505.w30.12gp145, (SEQ ID NO. 191)

MRVMGIQRNYPQWWIWSMLGFWMLMICNGMWVTVYYGVPVWKEAKTTLFCASDAKAYEKEVHNVWATHACVPTDPNPQE
MVLKNVTENFNMWKNDMVDQMHEDVISLWDQSLKPCVKLTPLCVTLNCTNATNATASNSSIIEGMKNCSFNITTELRDK
REKKNALFYKLDIVQLDGNSSQYRLINCNTSVITQACPKVSFDPIPIHYCAPAGYAILKCNNKTFTGTGPCNNVSTVQC
THGIKPVVSTQLLLNGSLAEGEIIIRSENITNNDKTIIVHLNESVKIECTRPSNKTRTSIRIGPGQAFYATGQVIGDIR
EAYCNISESKWNETLQRVSKKLKEYFPHKNITFQPSSGGDLEITTHSFNCGGEFFYCNTSSLFNRTYMANSTDMANSTE
TNSTRNITIHCRIKQIINMWQEVGRAMYAPPIAGNITCISNITGLLLTRDGGKNDTETFRPGGGNMKDNWRSELYKYKV
VEVKPLGVAPTNARRRVVEREKRAVGMGAVFLGFLGAAGSTMGAASITLTVQARQLLSGIVQQQSNLLKAIEAQQHMLK
LTVWGIKQLQARVLALERYLKDQQLLGMWGCSGKLICTTNVYWNSSWSNKTYGDIWDNMTWMQWEREISNYTEIIYELL
EESQNQQEKNEQDLLALDRWNSLWNWFNITNWLWYIKIFIMIVGGLIGLRIIFAVLSLVNRVRQG*

>CH505w136.B18gp145, HV1300724, (SEQ ID NO. 192)

MRVMGRQRNYPQWWIWSMLGLWMLMICNGMWVTVYYGVPVWKEAKTTLFCASDAKAYEKEVHNVWATHACVPTDPNPQE
MVLKNVTENFNMWKNDMVDQMHEDVISLWDQSLTPCVKLTPLCVTLNCTDANDTASNSSIIKGMNNSIVGEMKNCSFNI
TTELRDKREKKNALFYKLDIVQLDGNSSEYRLINCNTSVITQACPKVSFDPIPIHYCAPAGYAILKCNNKTFNGTGPCN
NVSTVQCTHGIKPVVSTQLLLNGSLAEGEIIIRSENITDNAKTIIVHLNESVKIECTRPSNNTRTSIRIGPGQAFYATG
QVIGDIRKAHCNISESKWNETLQRVSKKLKEYFPDKNITFQPSSGGDPEITTHSFNCGGEFFYCNTSSLFNRTYMANST
DMANSAETNSTRTITLHCRIKQIINMWQEVGRAMYAPPIAGNITCISNITGLLLTRDGGNSSTETETFRPGGGNMKDNW
RSELYKYKVVEVKPLGVAPTNARRRVVEREKRAVGMGAVFLGFLGAAGSTMGAASITLTVQARQLLSGIVQQQSNLLKA
IEAQQHMLRLTVWGIKQLQARVLALERYLKDQQLLGMWGCSGKLICTTNVYWNSSWSNKTYDDIWDNMTWMQWEGEISN
YTNIIYDLLEESQNQQEKNEQDLLALDRWNSLWNWFNITNWLWYIKIFIMIVGGLIGLRIIFAVLSLVNRVRQG*

>CH505.w136.B18 gp160 plasmid (SEQ ID NO. 193)

GTCGTCGACAAGAAGCCACCATGCGCGTGATGGGCCGGCAGCGCAACTACCCGCAGTGGTGGATCTGGTCGATGCT
GGGCCTCTGGATGCTCATGATCTGCAACGGCATGTGGGTGACGGTGTACTACGGCGTGCCGGTGTGGAAGGAGGCC
AAGACGACCCTGTTCTGCGCGTCGGACGCCAAGGCCTACGAGAAGGAGGTGCACAACGTGTGGGCGACCCACGCCT
GCGTGCCCACGGACCCCAACCCGCAGGAGATGGTGCTGAAGAACGTGACCGAGAACTTCAACATGTGGAAGAACGA
CATGGTGGACCAGATGCACGAGGACGTGATCTCCCTGTGGGACCAGTCCCTGACGCCCTGCGTGAAGCTGACCCCGC
TGTGCGTGACCCTGAACTGCACGGACGCCAACGACACCGCGTCGAACAGCTCCATCATCAAGGGGATGAACAACTCC
ATCGTGGGGGAGATGAAGAACTGCTCCTTCAACATCACGACGGAGCTGCGCGACAAGCGCGAGAAGAAGAACGCCC
TGTTCTACAAGCTGGACATCGTGCAGCTGGACGGCAACTCCTCGGAGTACAGGCTGATCAACTGCAACACCTCCGTCA
TCACGCAGGCGTGCCCCAAGGTGTCCTTCGACCCCATCCCCATCCACTACTGCGCCCCCGCCGGCTACGCCATCCTGA
AGTGCAACAACAAGACCTTCAACGGCACCGGCCCGTGCAACAACGTGTCCACCGTGCAGTGCACGCACGGGATCAAG
CCCGTGGTGTCCACGCAGCTGCTCCTGAACGGGTCGCTGGCCGAGGGCGAGATCATCATCCGGTCGGAGAACATCAC
GGACAACGCGAAGACCATCATCGTGCACCTGAACGAGTCCGTGAAGATCGAGTGCACCCGCCCGAGCAACAACACG
CGCACCTCCATCCGGATCGGCCCTGGCCAGGCCTTCTACGCCACCGGCCAGGTGATCGGCGACATCCGCAAGGCGCA
CTGCAACATCTCCGAGTCCAAGTGGAACGAGACCCTGCAGCGCGTGTCCAAGAAGCTGAAGGAGTACTTCCCCGACA
AGAACATCACCTTCCAGCCGTCGTCCGGCGGCGACCCCGAGATCACCACGCACTCCTTCAACTGCGGTGGCGAGTTCT
TCTACTGCAACACGTCGTCCCTGTTCAACCGCACCTACATGGCCAACTCGACGGACATGGCGAACTCCGCGGAGACCA
ACTCCACGCGCACCATCACGCTCCACTGCCGCATCAAGCAGATCATCAACATGTGGCAGGAGGTGGGCCGCGCCATG
TACGCACCGCCCATCGCCGGCAACATCACCTGCATCTCCAACATCACCGGCCTCCTGCTGACCCGCGACGGAGGCAAC
TCCAGCACGGAGACGGAGACCTTCAGGCCAGGGGGAGGCAACATGAAGGACAACTGGCGCTCCGAGCTGTACAAGT
ACAAGGTGGTGGAGGTGAAGCCCCTGGGCGTGGCACCCACCAACGCCCGCAGGCGCGTGGTGGAGCGCGAGAAGC
GCGCCGTGGGCATGGGCGCCGTGTTCCTGGGCTTCCTGGGCGCTGCGGGCTCCACCATGGGTGCCGCGTCCATCACC
CTGACCGTGCAGGCCCGCCAGCTGCTCTCCGGCATCGTGCAGCAGCAGTCCAACCTCCTGAAGGCCATCGAGGCCCA
GCAGCACATGCTGCGGCTGACCGTGTGGGGCATCAAGCAGCTGCAGGCCAGGGTGCTCGCGCTCGAGCGCTACCTG
AAGGACCAGCAGCTGCTCGGCATGTGGGGCTGCTCCGGCAAGCTGATCTGCACCACCAACGTGTACTGGAACTCGTC
CTGGTCCAACAAGACCTACGACGACATCTGGGACAACATGACCTGGATGCAGTGGGAGGGGGAGATCTCCAACTAC
ACCAACATCATCTACGACCTCCTCGAGGAGTCCCAGAACCAGCAGGAGAAGAACGAGCAGGATCTGCTCGCGCTGGA
CCGCTGGAACTCCCTGTGGAACTGGTTCAACATCACCAACTGGCTGTGGTACATCAAGATCTTCATCATGATCGTGGG
CGGCCTGATCGGCCTGCGGATCATCTTCGCCGTGCTGTCGCTGGTGAACCGCGTGCGCCAGGGCTACTCCCCGCTGTC
CCTGCAAACGCTGATCCCCTCCCCCCGGGGCCCGGACAGGCCCGGTGGCATCGAGGAGGAGGGCGGCGAGCAGGA
CCGCAAGCGCTCCACGCGCCTGGTGTCCGGCTTCCTGGCCCTGGTGTGGGACGACCTGCGCTCCCTGTGCCTGTTCCT
CTACCACCGCCTGCGCGACTTCATCCTGATCGCGGCCCGCGCTGGCGAGCTGCTGGGCCGGTCCTCGCTGAAGGGCC
TGCGCCGCGGCTGGGAGGCCCTGAAGTACCTGGGCAGCCTGGTGCAGTACTGGGGCCTGGAGCTGAAGCGCTCCGC
CATCTCCCTGCTGGACACCCTGGCCATCGCCGTGGGCGAGGGCACCGACCGCATCCTGGAGTTCGTGCTGGGCATCT
GCCGCGCCATCCGCAACATCCCCACCCGCATCCGCCAGGGCTTCGAGACCGCCCTCCTGTGATGAGGTCACCGGGAC
C

Figure 19B

>CH505w0.136.B18.gp160 (SEQ ID NO. 194)

MRVMGRQRNYPQWWIWSMLGLWMLMICNGMWVTVYYGVPVWKEAKTTLFCASDAKAYEKEVHNVWATHACVPT
DPNPQEMVLKNVTENFNMWKNDMVDQMHEDVISLWDQSLTPCVKLTPLCVTLNCTDANDTASNSSIIKGMNNSIVGE
MKNCSFNITTELRDKREKKNALFYKLDIVQLDGNSSEYRLINCNTSVITQACPKVSFDPIPIHYCAPAGYAILKCNNKTFNGTG
PCNNVSTVQCTHGIKPVVSTQLLLNGSLAEGEIIIRSENITDNAKTIIVHLNESVKIECTRPSNNTRTSIRIGPGQAFYATGQVI
GDIRKAHCNISESKWNETLQRVSKKLKEYFPDKNITFQPSSGGDPEITTHSFNCGGEFFYCNTSSLFNRTYMANSTDMANS
AETNSTRTITLHCRIKQIINMWQEVGRAMYAPPIAGNITCISNITGLLLTRDGGNSSTETETFRPGGGNMKDNWRSELYKYK
VVEVKPLGVAPTNARRRVVEREKRAVGMGAVFLGFLGAAGSTMGAASITLTVQARQLLSGIVQQQSNLLKAIEAQQHML
RLTVWGIKQLQARVLALERYLKDQQLLGMWGCSGKLICTTNVYWNSSWSNKTYDDIWDNMTWMQWEGEISNYTNIIY
DLLEESQNQQEKNEQDLLALDRWNSLWNWFNITNWLWYIKIFIMIVGGLIGLRIIFAVLSLVNRVRQGYSPLSLQTLIPSPR
GPDRPGGIEEEGGEQDRKRSTRLVSGFLALVWDDLRSLCLFLYHRLRDFILIAARAGELLGRSSLKGLRRGWEALKYLGSLVQ
YWGLELKRSAISLLDTLAIAVGEGTDRILEFVLGICRAIRNIPTRIRQGFETALL*

Figure 19B cont.

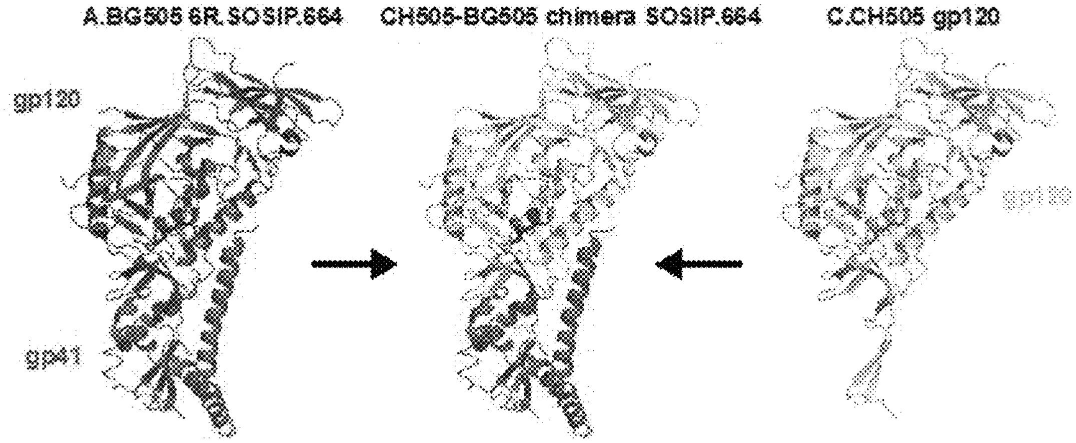

Figure 22A

>HV1301180, CH505TFchim.6R.SOSIP.664 (SEQ ID NO. 195)
ATGCCCATGGGCAGCCTGCAGCCCCTGGCCACCCTGTACCTGCTGGGCATGCTGGTGGCTAGCGTGCTGGCCGC
CGAGAACCTGTGGGTGACCGTCTACTATGGCGTGCCCGTCTGGAAGGAAGCCAAAACCACACTGTTCTGCGCTA
GCGACGCTAAGGCATACGAGAAAGAAGTGCACAATGTCTGGGCTACTCATGCATGCGTGCCTACCGATCCAAAT
CCCCAGGAGATGGTGCTGAAGAACGTCACAGAAAACTTTAATATGTGGAAGAACGACATGGTGGATCAGATGCA
CGAGGACGTGATCAGCCTGTGGGATCAGTCCCTGAAGCCATGCGTGAAACTGACTCCCCTGTGCGTCACCCTGA
ACTGTACTAATGCCACCGCTTCCAACAGCTCCATCATTGAGGGGATGAAGAACTGTTCTTTCAATATCACTACC
GAGCTGCGCGACAAGCGAGAAAAGAAAAATGCCCTGTTTTACAAACTGGACATCGTGCAGCTGGATGGCAACTC
TAGTCAGTATAGACTGATTAACTGCAATACAAGCGTGATCACTCAGGCATGTCCAAAGGTCAGTTTCGATCCTA
TTCCAATCCACTACTGCGCACCCGCCGGATATGCTATCCTGAAGTGTAACAACAAGACCTTCACCGGCACTGGG
CCTTGCAACAACGTGAGCACCGTCCAGTGTACACATGGCATTAAGCCAGTGGTCAGCACCCAGCTGCTGCTGAA
CGGCAGCCTGGCAGAGGGCGAAATCATTATCCGCAGCGAGAACATCACAAATAATGTGAAGACTATCATCGTCC
ACCTGAACGAGAGCGTGAAGATTGAATGCACACGGCCCAACAACAAGACCAGGACATCCATTCGCATCGGACCT
GGCCAGGCCTTCTACGCTACTGGCCAGGTCATCGGGGACATCAGAGAGGCCTATTGTAACATCAATGAGTCAAA
GTGGAATGAAACTCTGCAGAGGGTGAGCAAGAAACTGAAGGAATACTTCCCTCACAAAAACATCACCTTTCAGC
CATCAAGCGGCGGGGACCTGGAGATTACAACTCATTCTTTCAATTGCGGAGGCGAATTCTTTTACTGTAACACC
TCCTCTCTGTTTAATCGCACATATATGGCTAACAGTACTGATATGGCAAACTCTACTGAGACCAATAGTACACG
AACTATTACCATCCATTGCCGGATCAAGCAGATTATCAACATGTGGCAGGAAGTGGGGCGGGCCATGTATGCTC
CCCCTATTGCAGGAAATATTACCTGTATCAGCAACATTACCGGCCTGCTGCTGACAAGAGACGGGGGAAAGAAC
AATACAGAGACTTTTAGGCCTGGCGGGGGAAACATGAAAGATAATTGGCGCTCCGAGCTGTACAAGTATAAAGT
GGTCAAGATCGAACCACTGGGAGTGGCACCTACCCGATGTAAACGGAGAGTGGTCGGAAGGCGCCGACGGAGAA
GGGCAGTGGGAATCGGAGCCGTCTTCCTGGGCTTTCTGGGAGCAGCTGGCAGCACAATGGGAGCAGCCTCTATG
ACCCTGACAGTGCAGGCTCGAAATCTGCTGAGTGGGATCGTGCAGCAGCAGTCAAACCTGCTGCGAGCACCAGA
GGCACAGCAGCATCTGCTGAAGCTGACCGTGTGGGGCATCAAGCAGCTGCAGGCCAGAGTGCTGGCTGTCGAAC
GGTACCTGAGAGATCAGCAGCTGCTGGGAATCTGGGGATGCAGCGGAAAGCTGATTTGCTGTACAAACGTGCCC
TGGAATAGTTCATGGTCAAACAGGAATCTGAGCGAGATCTGGGACAATATGACCTGGCTGCAGTGGGATAAGGA
AATCAGTAACTACACACAGATCATCTATGGCCTGCTGGAGGAATCACAGAACCAGCAGGAGAAAAATGAACAGG
ACCTGCTGGCCCTGGATTGATGA

Figure 22B

>HV1301181, CH505w53.16chim.6R.SOSIP.664 (SEQ ID NO. 196)
ATGGGGAGCCTGCAGCCTCTGGCAACCCTGTATCTGCTGGGAATGCTGGTCGCAAGTGTCCTGGCCGCCGAAAA
CCTGTGGGTCACCGTGTATTATGGAGTGCCGGTGTGGAAGGAGGCCAAGACGACCCTGTTCTGCGCGTCGGACG
CCAAGGCCTACGAGAAGGAGGTGCACAACGTGTGGGCGACCCACGCCTGCGTGCCCACGGACCCCAACCCGCAG
GAGATGGTGCTGAAGAACGTGACCGAGAACTTCAACATGTGGAAGAACGACATGGTGGACCAGATGCACGAGGA
CGTGATCTCCCTGTGGGACCAGTCCCTGAAGCCCTGCGTGAAGCTGACCCCGCTGTGCGTGACCCTGAACTGCA
CCAACGCGAACGCCACCGCGTCCAACTCCTCTATCATCGAGGGGATGAACTCCTCCATCATCGAGGGCATGAAG
AACTGCTCCTTCAACATCACGACGGAGCTGCGCGACAAGCGCGAGAAGAAGAACGCCCTGTTCTACAAGCTGGA
CATCGTGCAGCTGGACGGCAACTCCTCGCAGTACAGGCTGATCAACTGCAACACCTCCGTCATCACGCAGGCGT
GCCCCAAGGTGTCCTTCGACCCCATCCCCATCCACTACTGCGCCCCCGCCGGCTACGCCATCCTGAAGTGCAAC
AACAAGACCTTCAACGGCACCGGCCCGTGCAACAACGTGTCCACCGTGCAGTGCACGCACGGGATCAAGCCCGT
GGTGTCCACGCAGCTGCTCCTGAACGGGTCGCTGGCCGAGGGCGAGATCATCATCCGGTCCGAGAACATCACGG
ACAACGGGAAGACCATCATCGTGCACCTGAACGAGTCCGTGAAGATCGAGTGCACCCGCCCGAGCAACAACACG
CGCACCTCCATCCGGATCGGCCCTGGCCAGGCCTTCTACGCCACCGGCCAGGTGATCGGCGACATCCGCGAGGC
GCACTGCAACATCTCGGAGTCCAAGTGGAACGAGACCCTGCAGCGCGTGTCCGAGAAGCTGAAGGAGTACTTCC
CCCACAAGAACATCACCTTCCAGCCGTCGTCCGGCGGCGACCTCGAGATCACCACGCACTCCTTCAACTGCGGT
GGCGAGTTCTTCTACTGCAACACGTCGTCGCTGTTCAACCGCACCTACATGGCCACGTCCACCGACATGGCCAA
CTCCACCGAGACCAACTCCACGCGCATCATCACGATCCGGTGCCGCATCAAGCAGATCATCAACATGTGGCAGG
AGGTGGGCCGCGCCATGTACGCACCGCCCATCGCCGGCAACATCACCTGCATCTCCAACATCACCGGCCTCCTG
CTGACCCGCGACGGCGGCAAGAACAACACGGAGACCTTCGAGACGTTCAGGCCAGGCGGAGGCAACATGAAGGA
TAACTGGAGGTCCGAGCTGTACAAGTATAAAGTGGTCAAGATCGAACCTCTGGGAGTGGCACCAACCAGATGCA
AGCGAAGAGTGGTCGGACGAAGGAGGAGGAGGCGAGCAGTCGGAATTGGGGCCGTGTTCCTGGGATTTCTGGGC
GCCGCTGGGAGTACAATGGGAGCAGCCTCAATGACTCTGACCGTGCAGGCCAGGAATCTGCTGAGCGGCATCGT
CCAGCAGCAGTCCAACCTGCTGCGCGCTCCTGAAGCACAGCAGCACCTGCTGAAGCTGACCGTGTGGGGCATCA
AACAGCTGCAGGCTAGGGTGCTGGCAGTCGAGCGGTACCTGAGAGACCAGCAGCTGCTGGGAATCTGGGGCTGC
TCTGGGAAGCTGATTTGTTGCACAAATGTGCCTTGGAACTCTAGTTGGTCAAATCGCAACCTGAGCGAGATCTG
GGACAATATGACTTGGCTGCAGTGGGATAAAGAAATTAGTAACTACACCCAGATCATCTACGGCCTGCTGGAAG
AGTCACAGAATCAGCAGGAGAAGAACGAACAGGACCTGCTGGCACTGGATTGA

>HV1301182, CH505w78.33 chim.6R.SOSIP.664 (SEQ ID NO. 197)
ATGGGGAGCCTGCAGCCTCTGGCAACCCTGTATCTGCTGGGAATGCTGGTCGCAAGTGTCCTGGCCGCCGAAAA
CCTGTGGGTCACCGTGTATTATGGAGTGCCGGTGTGGAAGGAGGCCAAGACGACCCTGTTCTGCGCGTCGGACG
CCAAGGCCTACGAGAAGGAGGTGCACAACGTGTGGGCGACCCACGCCTGCGTGCCCACGGACCCCAACCCGCAG
GAGATGGTGCTGAAGAACGTGACCGAGAACTTCAACATGTGGAAGAACGACATGGCGGACCAGATGCACGAGGA
CGTGATCTCCCTGTGGGACCAGTCCCTGAAGCCCTGCGTGAAGCTGACCCCGCTGTGCGTGACCCTGAACTGCA
TCGACGCCAACGCGACCGCGTCCAACGCGACGGCATCCAACTCGTCCATCATCGAGGGGATGAAGAACTGCTCC
TTCAACATCACGACGGAGCTGCGCGACAAGATCGAGAAGAAGAACGCCCTGTTCTACAAGCTGGACATCGTGCA
GCTGGACGGCAACTCCTCGCAGTACAGGCTGATCAACTGCAACACCTCCGTCATCACGCAGGCGTGCCCCAAGG
TGTCCTTCGACCCCATCCCCATCCACTACTGCGCCCCCGCCGGCTACGCCATCCTGAAGTGCAACAACAAGACC
TTCAACGGCACCGGCCCGTGCAACAACGTGTCCACCGTGCAGTGCACGCACGGGATCAAGCCCGTGGTGTCCAC
GCAGCTGCTCCTGAACGGGTCGCTGGCCGAGGGCGAGATCATCATCCGGTCGGAGAACATCACGAACAGCGCGA
AGACCATCATCGTGCACCTGAACGAGTCCGTGAAGATCGAGTGCACCCGCCCGAGCAACAACACGCGCACCTCC
ATCCGGATCGGCCCTGGCCAGGCCTTCTACGCCACCGGCCAGGTGATCGGCGACATCCGCAAGGCGCACTGCAA
CATCTCCGAGTCCAAGTGGAACGAGACCCTGCAGCGCGTGTCCAAGAAGCTGAAGGAGTACTTCCCCCACAAGA
ACATCACCTTCCAGCCGTCGTCCGGCGGCGACCTCGAGATCACCACGCACTCCTTCAACTGCGGTGGCGAGTTC
TTCTACTGCAACACGTCGTCGCTGTTCAACCGCACCTACATGGCCAACTCCACCGAGACCAACTCCACGCGCAC
GATCACGCTCCACTGCCGCATCAAGCAGATCATCAACATGTGGCAGGAGGTGGGCCGCGCCATGTACGCACCGC
CCATCGCCGGCAACATCACCTGCATCTCCAACATCACCGGCCTCCTGCTGACCCGCGACGGCGGCAACAACAAC
ACCACGGAGACCTTCAGGCCAGGGGGAGGCAACATGAAGGATAACTGGAGGTCCGAGCTGTACAAGTATAAAGT
GGTCAAGATCGAACCTCTGGGAGTGGCACCAACCAGATGCAAGCGAAGAGTGGTCGGACGAAGGAGGAGGAGGC
GAGCAGTCGGAATTGGGGCCGTGTTCCTGGGATTTCTGGGCGCCGCTGGGAGTACAATGGGAGCAGCCTCAATG
ACTCTGACCGTGCAGGCCAGGAATCTGCTGAGCGGCATCGTCCAGCAGCAGTCCAACCTGCTGCGCGCTCCTGA
AGCAC

Figure 22B cont.

AGCAGCACCTGCTGAAGCTGACCGTGTGGGGCATCAAACAGCTGCAGGCTAGGGTGCTGGCAGTCGAGCGGTAC
CTGAGAGACCAGCAGCTGCTGGGAATCTGGGGCTGCTCTGGGAAGCTGATTTGTTGCACAAATGTGCCTTGGAA
CTCTAGTTGGTCAAATCGCAACCTGAGCGAGATCTGGGACAATATGACTTGGCTGCAGTGGGATAAAGAAATTA
GTAACTACACCCAGATCATCTACGGCCTGCTGGAAGAGTCACAGAATCAGCAGGAGAAGAACGAACAGGACCTG
CTGGCACTGGATTGA

>HV1301183, CH505w100.B6 chim.6R.SOSIP.664 (SEQ ID NO. 198)
ATGGGGAGCCTGCAGCCTCTGGCAACCCTGTATCTGCTGGGAATGCTGGTCGCAAGTGTCCTGGCCGCCGAAAA
CCTGTGGGTCACCGTGTATTATGGAGTGCCGGTGTGGAAGGAGGCCAAGACGACCCTGTTCTGCGCGTCGGACG
CCAAGGCCTACGAGAAGGAGGTGCACAACGTGTGGGCGACCCACGCCTGCGTGCCCACGGACCCCAACCCGCAG
GAGATGGTGCTGGAGAACGTGACCGAGAACTTCAACATGTGGAAGAACGACATGGCGGACCAGATGCACGAGGA
CGTGATCTCCCTGTGGGACCAGTCCCTGAAGCCCTGCGTGAAGCTGACCCCGCTGTGCGTGACCCTGAACTGCA
CGGACGCCAACGCCACCGCGTCGAACACCAACGCGACCGCAAGCAACATCAACGCGACGGCGTCGAAGTCCTCC
ATCATCGAGGAGATGAAGAACTGCTCCTTCAACATCACGACGGAGCTGCGCGACAAGCGCGAGAAGAAGTACGC
CCTGTTCTACAAGCTGGACATCGTGCAGCTGGACGGCAACTCCTCGCAGTACAGGCTGATCAACTGCAACACCT
CCGTCATCACGCAGGCGTGCCCCAAGGTGTCCTTCGACCCCATCCCCATCCACTACTGCGCCCCCGCCGGCTAC
GCCATCCTGAAGTGCAACAACAAGACCTTCAACGGCACCGGCCCGTGCAACAACGTGTCCACCGTGCAGTGCAC
GCACGGGATCAAGCCCGTGGTGTCCACGCAGCTGCTCCTGAACGGGTCGCTGGCCGAGGGCGAGATCATCATCC
GGTCGGAGAACATCACGGACAACAGCAAGACCATCATCGTGCACCTGAACGAGTCCGTGAAGATCGAGTGCACC
CGCCCGAGCAACAACACGCGCACCTCCATCCGGATCGGCCCTGGCCAGGCCTTCTACGCCACCGGCCAAGTGAT
CGGCGACATCCGCGAGGCGCACTGCAACATCTCCGAGTCCAAGTGGAACGAGACCCTGCAGCGCGTGTCCAAGA
AGCTGAAGGAGTACTTCCCCGACAAGAACATCACCTTCCAGCCGTCGTCCGGCGGCGACCCCGAGATCACCACG
CACTCCTTCAACTGCGGTGGCGAGTTCTTCTACTGCAACACGTCGTCCCTGTTCAACCGCACCTACATGGCGAA
CTCCACCGAGACCAACTCCACGCGCACCATCACGCTGCACTGCCGCATCAAGCAGATCATCAACATGTGGCAGG
AGGTGGGCCGCGCCATGTACGCACCGCCCATCGCCGGCAACATCACCTGCATCTCCAACATCACCGGCCTCCTG
CTGACCCGCGACGGCGGCGAGAACACCCGGGACGGAGGCAACAACAACACGGAGACCTTCAGGCCAGAGGGAGG
CAACATGAAGGATAACTGGAGGTCCGAGCTGTACAAGTATAAAGTGGTCAAGATCGAACCTCTGGGAGTGGCAC
CAACCAGATGCAAGCGAAGAGTGGTCGGACGAAGGAGGAGGAGGCGAGCAGTCGGAATTGGGGCCGTGTTCCTG
GGATTTCTGGGCGCCGCTGGGAGTACAATGGGAGCAGCCTCAATGACTCTGACCGTGCAGGCCAGGAATCTGCT
GAGCGGCATCGTCCAGCAGCAGTCCAACCTGCTGCGCGCTCCTGAAGCACAGCAGCACCTGCTGAAGCTGACCG
TGTGGGGCATCAAACAGCTGCAGGCTAGGGTGCTGGCAGTCGAGCGGTACCTGAGAGACCAGCAGCTGCTGGGA
ATCTGGGGCTGCTCTGGGAAGCTGATTTGTTGCACAAATGTGCCTTGGAACTCTAGTTGGTCAAATCGCAACCT
GAGCGAGATCTGGGACAATATGACTTGGCTGCAGTGGGATAAAGAAATTAGTAACTACACCCAGATCATCTACG
GCCTGCTGGAAGAGTCACAGAATCAGCAGGAGAAGAACGAACAGGACCTGCTGGCACTGGATTGA

>HV1301143, CH505TFchim.DS.6R.SOSIP.664 (SEQ ID NO. 199)
ATGCCCATGGGCAGCCTGCAGCCCCTGGCCACCCTGTACCTGCTGGGCATGCTGGTGGCTAGCGTGCTGGCCGC
CGAGAACCTGTGGGTGACCGTCTACTATGGCGTGCCCGTCTGGAAGGAAGCCAAAACCACACTGTTCTGCGCTA
GCGACGCTAAGGCATACGAGAAAGAAGTGCACAATGTCTGGGCTACTCATGCATGCGTGCCTACCGATCCAAAT
CCCCAGGAGATGGTGCTGAAGAACGTCACAGAAAACTTTAATATGTGGAAGAACGACATGGTGGATCAGATGCA
CGAGGACGTGATCAGCCTGTGGGATCAGTCCCTGAAGCCATGCGTGAAACTGACTCCCCTGTGCGTCACCCTGA
ACTGTACTAATGCCACCGCTTCCAACAGCTCCATCATTGAGGGGATGAAGAACTGTTCTTTCAATATCACTACC
GAGCTGCGCGACAAGCGAGAAAAGAAAAATGCCCTGTTTTACAAACTGGACATCGTGCAGCTGGATGGCAACTC
TAGTCAGTATAGACTGATTAACTGCAATACAAGCGTGTGCACTCAGGCATGTCCAAAGGTCAGTTTCGATCCTA
TTCCAATCCACTACTGCGCACCCGCCGGATATGCTATCCTGAAGTGTAACAACAAGACCTTCACCGGCACTGGG
CCTTGCAACAACGTGAGCACCGTCCAGTGTACACATGGCATTAAGCCAGTGGTCAGCACCCAGCTGCTGCTGAA
CGGCAGCCTGGCAGAGGGCGAAATCATTATCCGCAGCGAGAACATCACAAATAATGTGAAGACTATCATCGTCC
ACCTGAACGAGAGCGTGAAGATTGAATGCACACGGCCCAACAACAAGACCAGGACATCCATTCGCATCGGACCT
GGCCAGGCCTTCTACGCTACTGGCCAGGTCATCGGGGACATCAGAGAGGCCTATTGTAACATCAATGAGTCAAA
GTGGAATGAAACTCTGCAGAGGGTGAGCAAGAAACTGAAGGAATACTTCCCTCACAAAAACATCACCTTTCAGC
CATCAAGCGGCGGGGACCTGGAGATTACAACTCATTCTTTCAATTGCGGAGGCGAATTCTTTTACTGTAACACC
TCCTCTCTGTTTAATCGCACATATAT

Figure 22B cont.

GGCTAACAGTACTGATATGGCAAACTCTACTGAGACCAATAGTACACGAACTATTACCATCCATTGCCGGA
TCAAGCAGATTATCAACATGTGGCAGGAAGTGGGGCGGTGCATGTATGCTCCCCCTATTGCAGGAAATATTACC
TGTATCAGCAACATTACCGGCCTGCTGCTGACAAGAGACGGGGGAAAGAACAATACAGAGACTTTTAGGCCTGG
CGGGGGAAACATGAAAGATAATTGGCGCTCCGAGCTGTACAAGTATAAAGTGGTCAAGATCGAACCACTGGGAG
TGGCACCTACCCGATGTAAACGGAGAGTGGTCGGAAGGCGCCGACGGAGAAGGGCAGTGGGAATCGGAGCCGTC
TTCCTGGGCTTTCTGGGAGCAGCTGGCAGCACAATGGGAGCAGCCTCTATGACCCTGACAGTGCAGGCTCGAAA
TCTGCTGAGTGGGATCGTGCAGCAGCAGTCAAACCTGCTGCGAGCACCAGAGGCACAGCAGCATCTGCTGAAGC
TGACCGTGTGGGGCATCAAGCAGCTGCAGGCCAGAGTGCTGGCTGTCGAACGGTACCTGAGAGATCAGCAGCTG
CTGGGAATCTGGGGATGCAGCGGAAAGCTGATTTGCTGTACAAACGTGCCCTGGAATAGTTCATGGTCAAACAG
GAATCTGAGCGAGATCTGGGACAATATGACCTGGCTGCAGTGGGATAAGGAAATCAGTAACTACACACAGATCA
TCTATGGCCTGCTGGAGGAATCACAGAACCAGCAGGAGAAAAATGAACAGGACCTGCTGGCCCTGGATTGATGA

>HV1301144, CH505w53.16chim.DS.6R.SOSIP.664 (SEQ ID NO. 200)
ATGGGGAGCCTGCAGCCTCTGGCAACCCTGTATCTGCTGGGAATGCTGGTCGCAAGTGTCCTGGCCGCCGAAAA
CCTGTGGGTCACCGTGTATTATGGAGTGCCGGTGTGGAAGGAGGCCAAGACGACCCTGTTCTGCGCGTCGGACG
CCAAGGCCTACGAGAAGGAGGTGCACAACGTGTGGGCGACCCACGCCTGCGTGCCCACGGACCCCAACCCGCAG
GAGATGGTGCTGAAGAACGTGACCGAGAACTTCAACATGTGGAAGAACGACATGGTGGACCAGATGCACGAGGA
CGTGATCTCCCTGTGGGACCAGTCCCTGAAGCCCTGCGTGAAGCTGACCCCGCTGTGCGTGACCCTGAACTGCA
CCAACGCGAACGCCACCGCGTCCAACTCCTCTATCATCGAGGGGATGAACTCCTCCATCATCGAGGGCATGAAG
AACTGCTCCTTCAACATCACGACGGAGCTGCGCGACAAGCGCGAGAAGAAGAACGCCCTGTTCTACAAGCTGGA
CATCGTGCAGCTGGACGGCAACTCCTCGCAGTACAGGCTGATCAACTGCAACACCTCCGTCTGCACGCAGGCGT
GCCCCAAGGTGTCCTTCGACCCCATCCCCATCCACTACTGCGCCCCCGCCGGCTACGCCATCCTGAAGTGCAAC
AACAAGACCTTCAACGGCACCGGCCCGTGCAACAACGTGTCCACCGTGCAGTGCACGCACGGGATCAAGCCCGT
GGTGTCCACGCAGCTGCTCCTGAACGGGTCGCTGGCCGAGGGCGAGATCATCATCCGGTCCGAGAACATCACGG
ACAACGGGAAGACCATCATCGTGCACCTGAACGAGTCCGTGAAGATCGAGTGCACCCGCCCGAGCAACAACACG
CGCACCTCCATCCGGATCGGCCCTGGCCAGGCCTTCTACGCCACCGGCCAGGTGATCGGCGACATCCGCGAGGC
GCACTGCAACATCTCGGAGTCCAAGTGGAACGAGACCCTGCAGCGCGTGTCCGAGAAGCTGAAGGAGTACTTCC
CCCACAAGAACATCACCTTCCAGCCGTCGTCCGGCGGCGACCTCGAGATCACCACGCACTCCTTCAACTGCGGT
GGCGAGTTCTTCTACTGCAACACGTCGTCGCTGTTCAACCGCACCTACATGGCCACGTCCACCGACATGGCCAA
CTCCACCGAGACCAACTCCACGCGCATCATCACGATCCGGTGCCGCATCAAGCAGATCATCAACATGTGGCAGG
AGGTGGGCCGCTGCATGTACGCACCGCCCATCGCCGGCAACATCACCTGCATCTCCAACATCACCGGCCTCCTG
CTGACCCGCGACGGCGGCAAGAACAACACGGAGACCTTCGAGACGTTCAGGCCAGGCGGAGGCAACATGAAGGA
TAACTGGAGGTCCGAGCTGTACAAGTATAAAGTGGTCAAGATCGAACCTCTGGGAGTGGCACCAACCAGATGCA
AGCGAAGAGTGGTCGGACGAAGGAGGAGGAGGCGAGCAGTCGGAATTGGGGCCGTGTTCCTGGGATTTCTGGGC
GCCGCTGGGAGTACAATGGGAGCAGCCTCAATGACTCTGACCGTGCAGGCCAGGAATCTGCTGAGCGGCATCGT
CCAGCAGCAGTCCAACCTGCTGCGCGCTCCTGAAGCACAGCAGCACCTGCTGAAGCTGACCGTGTGGGGCATCA
AACAGCTGCAGGCTAGGGTGCTGGCAGTCGAGCGGTACCTGAGAGACCAGCAGCTGCTGGGAATCTGGGGCTGC
TCTGGGAAGCTGATTTGTTGCACAAATGTGCCTTGGAACTCTAGTTGGTCAAATCGCAACCTGAGCGAGATCTG
GGACAATATGACTTGGCTGCAGTGGGATAAAGAAATTAGTAACTACACCCAGATCATCTACGGCCTGCTGGAAG
AGTCACAGAATCAGCAGGAGAAGAACGAACAGGACCTGCTGGCACTGGATTGA

>HV1301145, CH505w78.33 chim.DS.6R.SOSIP.664 (SEQ ID NO. 201)
ATGGGGAGCCTGCAGCCTCTGGCAACCCTGTATCTGCTGGGAATGCTGGTCGCAAGTGTCCTGGCCGCCGAAAA
CCTGTGGGTCACCGTGTATTATGGAGTGCCGGTGTGGAAGGAGGCCAAGACGACCCTGTTCTGCGCGTCGGACG
CCAAGGCCTACGAGAAGGAGGTGCACAACGTGTGGGCGACCCACGCCTGCGTGCCCACGGACCCCAACCCGCAG
GAGATGGTGCTGAAGAACGTGACCGAGAACTTCAACATGTGGAAGAACGACATGGCGGACCAGATGCACGAGGA
CGTGATCTCCCTGTGGGACCAGTCCCTGAAGCCCTGCGTGAAGCTGACCCCGCTGTGCGTGACCCTGAACTGCA
TCGACGCCAACGCGACCGCGTCCAACGCGACGGCATCCAACTCGTCCATCATCGAGGGGATGAAGAACTGCTCC
TTCAACATCACGACGGAGCTGCGCGACAAGATCGAGAAGAAGAACGCCCTGTTCTACAAGCTGGACATCGTGCA
GCTGGACGGCAACTCCTCGCAGTACAGGCTGATCAACTGCAACACCTCCGTCTGCACGCAGGCGTGCCCCAAGG
TGTCCTTCGACCCCATCCCCATCCACTACTGCGCCCCCGCCGGCTACGCCATCCTGAAGTGCAACAACAAGACC
TTCAACGGCACCGGCCCGTGCAACAACGTGTCCACCGTGCAGTGCACGCACGGGATCAAGCCCGTGGTGTCCAC
GCAGCTGCTCCTGAACGGGTCGCTGGCCGAGGGCGAGATCA

Figure 22B cont.

TCATCCGGTCGGAGAACATCACGAACAGCGCGAAGACCATCATCGTGCACCTGAACGAGTCCGTGAAGATCGAG
TGCACCCGCCCGAGCAACAACACGCGCACCTCCATCCGGATCGGCCCTGGCCAGGCCTTCTACGCCACCGGCCA
GGTGATCGGCGACATCCGCAAGGCGCACTGCAACATCTCCGAGTCCAAGTGGAACGAGACCCTGCAGCGCGTGT
CCAAGAAGCTGAAGGAGTACTTCCCCCACAAGAACATCACCTTCCAGCCGTCGTCCGGCGGCGACCTCGAGATC
ACCACGCACTCCTTCAACTGCGGTGGCGAGTTCTTCTACTGCAACACGTCGTCGCTGTTCAACCGCACCTACAT
GGCCAACTCCACCGAGACCAACTCCACGCGCACGATCACGCTCCACTGCCGCATCAAGCAGATCATCAACATGT
GGCAGGAGGTGGGCCGCTGCATGTACGCACCGCCCATCGCCGGCAACATCACCTGCATCTCCAACATCACCGGC
CTCCTGCTGACCCGCGACGGCGGCAACAACAACACCACGGAGACCTTCAGGCCAGGGGGAGGCAACATGAAGGA
TAACTGGAGGTCCGAGCTGTACAAGTATAAAGTGGTCAAGATCGAACCTCTGGGAGTGGCACCAACCAGATGCA
AGCGAAGAGTGGTCGGACGAAGGAGGAGGAGGCGAGCAGTCGGAATTGGGGCCGTGTTCCTGGGATTTCTGGGC
GCCGCTGGGAGTACAATGGGAGCAGCCTCAATGACTCTGACCGTGCAGGCCAGGAATCTGCTGAGCGGCATCGT
CCAGCAGCAGTCCAACCTGCTGCGCGCTCCTGAAGCACAGCAGCACCTGCTGAAGCTGACCGTGTGGGGCATCA
AACAGCTGCAGGCTAGGGTGCTGGCAGTCGAGCGGTACCTGAGAGACCAGCAGCTGCTGGGAATCTGGGGCTGC
TCTGGGAAGCTGATTTGTTGCACAAATGTGCCTTGGAACTCTAGTTGGTCAAATCGCAACCTGAGCGAGATCTG
GGACAATATGACTTGGCTGCAGTGGGATAAAGAAATTAGTAACTACACCCAGATCATCTACGGCCTGCTGGAAG
AGTCACAGAATCAGCAGGAGAAGAACGAACAGGACCTGCTGGCACTGGATTGA

>HV1301146, CH505w100.B6 chim.DS.6R.SOSIP.664 (SEQ ID NO. 202)
ATGGGGAGCCTGCAGCCTCTGGCAACCCTGTATCTGCTGGGAATGCTGGTCGCAAGTGTCCTGGCCGCCGAAAA
CCTGTGGGTCACCGTGTATTATGGAGTGCCGGTGTGGAAGGAGGCCAAGACGACCCTGTTCTGCGCGTCGGACG
CCAAGGCCTACGAGAAGGAGGTGCACAACGTGTGGGCGACCCACGCCTGCGTGCCCACGGACCCCAACCCGCAG
GAGATGGTGCTGGAGAACGTGACCGAGAACTTCAACATGTGGAAGAACGACATGGCGGACCAGATGCACGAGGA
CGTGATCTCCCTGTGGGACCAGTCCCTGAAGCCCTGCGTGAAGCTGACCCCGCTGTGCGTGACCCTGAACTGCA
CGGACGCCAACGCCACCGCGTCGAACACCAACGCGACCGCAAGCAACATCAACGCGACGGCGTCGAAGTCCTCC
ATCATCGAGGAGATGAAGAACTGCTCCTTCAACATCACGACGGAGCTGCGCGACAAGCGCGAGAAGAAGTACGC
CCTGTTCTACAAGCTGGACATCGTGCAGCTGGACGGCAACTCCTCGCAGTACAGGCTGATCAACTGCAACACCT
CCGTCTGCACGCAGGCGTGCCCCAAGGTGTCCTTCGACCCCATCCCCATCCACTACTGCGCCCCCGCCGGCTAC
GCCATCCTGAAGTGCAACAACAAGACCTTCAACGGCACCGGCCCGTGCAACAACGTGTCCACCGTGCAGTGCAC
GCACGGGATCAAGCCCGTGGTGTCCACGCAGCTGCTCCTGAACGGGTCGCTGGCCGAGGGCGAGATCATCATCC
GGTCGGAGAACATCACGGACAACAGCAAGACCATCATCGTGCACCTGAACGAGTCCGTGAAGATCGAGTGCACC
CGCCCGAGCAACAACACGCGCACCTCCATCCGGATCGGCCCTGGCCAGGCCTTCTACGCCACCGGCCAAGTGAT
CGGCGACATCCGCGAGGCGCACTGCAACATCTCCGAGTCCAAGTGGAACGAGACCCTGCAGCGCGTGTCCAAGA
AGCTGAAGGAGTACTTCCCCGACAAGAACATCACCTTCCAGCCGTCGTCCGGCGGCGACCCCGAGATCACCACG
CACTCCTTCAACTGCGGTGGCGAGTTCTTCTACTGCAACACGTCGTCCCTGTTCAACCGCACCTACATGGCGAA
CTCCACCGAGACCAACTCCACGCGCACCATCACGCTGCACTGCCGCATCAAGCAGATCATCAACATGTGGCAGG
AGGTGGGCCGCTGCATGTACGCACCGCCCATCGCCGGCAACATCACCTGCATCTCCAACATCACCGGCCTCCTG
CTGACCCGCGACGGCGGCGAGAACACCCGGGACGGAGGCAACAACAACACGGAGACCTTCAGGCCAGAGGGAGG
CAACATGAAGGATAACTGGAGGTCCGAGCTGTACAAGTATAAAGTGGTCAAGATCGAACCTCTGGGAGTGGCAC
CAACCAGATGCAAGCGAAGAGTGGTCGGACGAAGGAGGAGGAGGCGAGCAGTCGGAATTGGGGCCGTGTTCCTG
GGATTTCTGGGCGCCGCTGGGAGTACAATGGGAGCAGCCTCAATGACTCTGACCGTGCAGGCCAGGAATCTGCT
GAGCGGCATCGTCCAGCAGCAGTCCAACCTGCTGCGCGCTCCTGAAGCACAGCAGCACCTGCTGAAGCTGACCG
TGTGGGGCATCAAACAGCTGCAGGCTAGGGTGCTGGCAGTCGAGCGGTACCTGAGAGACCAGCAGCTGCTGGGA
ATCTGGGGCTGCTCTGGGAAGCTGATTTGTTGCACAAATGTGCCTTGGAACTCTAGTTGGTCAAATCGCAACCT
GAGCGAGATCTGGGACAATATGACTTGGCTGCAGTGGGATAAAGAAATTAGTAACTACACCCAGATCATCTACG
GCCTGCTGGAAGAGTCACAGAATCAGCAGGAGAAGAACGAACAGGACCTGCTGGCACTGGATTGA
>HV1301288, CH505M5chim.6R.SOSIP.664v4.1 (SEQ ID NO. 203)
ATGCCCATGGGCTCCCTGCAGCCCCTGGCCACCCTGTACCTGCTGGGCATGCTGGTGGCCTCCGTGCTGGCCGC
CGAGAACCTGTGGGTGACCGTGTACTACGGCGTGCCCGTGTGGAAGGAGGCCAAGACCACCCTGTTCTGCGCCT
CCGACGCCAAGGCCTACGAGAAGAAGGTGCACAACGTGTGGGCCACCCACGCCTGCGTGCCCACCGACCCCAAC
CCCCAGGAGATGGTGCTGAAGAACGTGACCGAGAACTTCAACATGTGGAAGAACGACATGGT

Figure 22B cont.

GGACCAGATGCACGAGGACGTGATCTCCCTGTGGGACCAGTCCCTGAAGCCCTGCGTGAAGCTGACCCCCCTGT
GCGTGACCCTGAACTGCACCAACGCCACCGCCTCCAACTCCTCCATCATCGAGGGCATGAAGAACTGCTCCTTC
AACATCACCACCGAGCTGCGCGACAAGCGCGAGAAGAAGAACGCCCTGTTCTACAAGCTGGACATCGTGCAGCT
GGACGGCAACTCCTCCCAGTACCGCCTGATCAACTGCAACACCTCCGTGATCACCCAGGCCTGCCCCAAGGTGT
CCTTCGACCCCATCCCCATCCACTACTGCGCCCCCGCCGGCTACGCCATCCTGAAGTGCAACAACAAGACCTTC
ACCGGCACCGGCCCCTGCAACAACGTGTCCACCGTGCAGTGCACCCACGGCATCAAGCCCGTGGTGTCCACCCA
GCTGCTGCTGAACGGCTCCCTGGCCGAGGGCGAGATCATCATCCGCTCCGAGAACATCACCAAGAACGTGAAGA
CCATCATCGTGCACCTGAACGAGTCCGTGAAGATCGAGTGCACCCGCCCCAACAACAAGACCCGCACCTCCATC
CGCATCGGCCCCGGCCAGTGGTTCTACGCCACCGGCCAGGTGATCGGCGACATCCGCGAGGCCTACTGCAACAT
CAACGAGTCCAAGTGGAACGAGACCCTGCAGCGCGTGTCCAAGAAGCTGAAGGAGTACTTCCCCCACAAGAACA
TCACCTTCCAGCCCTCCTCCGGCGGCGACCTGGAGATCACCACCCACTCCTTCAACTGCGGCGGCGAGTTCTTC
TACTGCAACACCTCCTCCCTGTTCAACCGCACCTACATGGCCAACTCCACCGACATGGCCAACTCCACCGAGAC
CAACTCCACCCGCACCATCACCATCCACTGCCGCATCAAGCAGATCATCAACATGTGGCAGGAGGTGGGCCGCG
CCATGTACGCCCCCCCCATCGCCGGCAACATCACCTGCATCTCCAACATCACCGGCCTGCTGCTGACCCGCGAC
GGCGGCAAGAACAACACCGAGACCTTCCGCCCCGGCGGCGGCAACATGAAGGACAACTGGCGCTCCGAGCTGTA
CAAGTACAAGGTGGTGAAGATCGAGCCCCTGGGCGTGGCCCCCACCCGCTGCAAGCGCCGCGTGGTGGGCCGCC
GCCGCCGCCGCCGCGCCGTGGGCATCGGCGCCGTGTTCCTGGGCTTCCTGGGCGCCGCCGGCTCCACCATGGGC
GCCGCCTCCATGACCCTGACCGTGCAGGCCCGCAACCTGCTGTCCGGCATCGTGCAGCAGCAGTCCAACCTGCT
GCGCGCCCCCGAGGCCCAGCAGCACCTGCTGAAGCTGACCGTGTGGGGCATCAAGCAGCTGCAGGCCCGCGTGC
TGGCCGTGGAGCGCTACCTGCGCGACCAGCAGCTGCTGGGCATCTGGGGCTGCTCCGGCAAGCTGATCTGCTGC
ACCAACGTGCCCTGGAACTCCTCCTGGTCCAACCGCAACCTGTCCGAGATCTGGGACAACATGACCTGGCTGCA
GTGGGACAAGGAGATCTCCAACTACACCCAGATCATCTACGGCCTGCTGGAGGAGTCCCAGAACCAGCAGGAGA
AGAACGAGCAGGACCTGCTGGCCCTGGACTAG

>HV1301297, CH505M5chim.6R.SOSIP.664v4.2 (SEQ ID NO. 204)

ATGCCCATGGGCTCCCTGCAGCCCCTGGCCACCCTGTACCTGCTGGGCATGCTGGTGGCCTCCGTGCTGGCCGC
CGAGAACCTGTGGGTGACCGTGTACTACGGCGTGCCCGTGTGGAAGGAGGCCAAGACCACCCTGTTCTGCGCCT
CCGACGCCAAGGCCTACGAGAAGGAGGTGCGCAACGTGTGGGCCACCCACGCCTGCGTGCCCACCGACCCCAAC
CCCCAGGAGATGGTGCTGAAGAACGTGACCGAGAACTTCAACATGTGGAAGAACGACATGGTGGACCAGATGCA
CGAGGACGTGATCTCCCTGTGGGACCAGTCCCTGAAGCCCTGCGTGAAGCTGACCCCCCTGTGCGTGACCCTGA
ACTGCACCAACGCCACCGCCTCCAACTCCTCCATCATCGAGGGCATGAAGAACTGCTCCTTCAACATCACCACC
GAGCTGCGCGACAAGCGCGAGAAGAAGAACGCCCTGTTCTACAAGCTGGACATCGTGCAGCTGGACGGCAACTC
CTCCCAGTACCGCCTGATCAACTGCAACACCTCCGTGATCACCCAGGCCTGCCCCAAGGTGTCCTTCGACCCCA
TCCCCATCCACTACTGCGCCCCCGCCGGCTACGCCATCCTGAAGTGCAACAACAAGACCTTCACCGGCACCGGC
CCCTGCAACAACGTGTCCACCGTGCAGTGCACCCACGGCATCAAGCCCGTGGTGTCCACCCAGCTGCTGCTGAA
CGGCTCCCTGGCCGAGGGCGAGATCATCATCCGCTCCGAGAACATCACCAAGAACGTGAAGACCATCATCGTGC
ACCTGAACGAGTCCGTGAAGATCGAGTGCACCCGCCCCAACAACAAGACCCGCACCTCCATCCGCATCGGCCCC
GGCCAGTGGTTCTACGCCACCGGCCAGGTGATCGGCGACATCCGCGAGGCCTACTGCAACATCAACGAGTCCAA
GTGGAACGAGACCCTGCAGCGCGTGTCCAAGAAGCTGAAGGAGTACTTCCCCCACAAGAACATCACCTTCCAGC
CCTCCTCCGGCGGCGACCTGGAGATCACCACCCACTCCTTCAACTGCGGCGGCGAGTTCTTCTACTGCAACACC
TCCTCCCTGTTCAACCGCACCTACATGGCCAACTCCACCGACATGGCCAACTCCACCGAGACCAACTCCACCCG
CACCATCACCATCCACTGCCGCATCAAGCAGATCATCAACATGTGGCAGGAGGTGGGCCGCGCCATGTACGCCC
CCCCCATCGCCGGCAACATCACCTGCATCTCCAACATCACCGGCCTGCTGCTGACCCGCGACGGCGGCAAGAAC
AACACCGAGACCTTCCGCCCCGGCGGCGGCAACATGAAGGACAACTGGCGCTCCGAGCTGTACAAGTACAAGGT
GGTGAAGATCGAGCCCCTGGGCGTGGCCCCCACCCGCTGCAAGCGCCGCGTGGTGGGCCGCCGCCGCCGCCGCC
GCGCCGTGGGCATCGGCGCCGTGTTCCTGGGCTTCCTGGGCGCCGCCGGCTCCACCATGGGCGCCGCCTCCATG
ACCCTGACCGTGCAGGCCCGCAACCTGCTGTCCGGCATCGTGCAGCAGCAGTCCAACCTGCTGCGCGCCCCCGA
GGCCCAGCAGCACCTGCTGAAGCTGACCGTGTGGGGCATCAAGCAGCTGCAGGCCCGCGTGCTGGCCGTGGAGC
GCTACCTGCGCGACCAGCAGCTGCTGGGCATCTGGGGCTGCTCCGGCAAGCTGATCTGCTGCACCAACGTGCCC
TGGAACTCCTCCTGGTCCAACCGCAACCTGTCCGAGATCTGGGACAACATGACCTGGCTGCAGTGGGACAAGGA
GATCTCCAACTACACCCAGATCATCTACGGCCTGCTGGAGGAGTCCCAGAACCAGCAGGAGAAGAACGAGCAGG
ACCTGCTGGCCCTGGACTAG

Figure 22B cont.

>HV1301289, CH505M11chim.6R.SOSIP.664v4.1 (SEQ ID NO. 205)
ATGCCCATGGGCTCCCTGCAGCCCCTGGCCACCCTGTACCTGCTGGGCATGCTGGTGGCCTCCGTGCTGGCCGC
CGAGAACCTGTGGGTGACCGTGTACTACGGCGTGCCCGTGTGGAAGGAGGCCAAGACCACCCTGTTCTGCGCCT
CCGACGCCAAGGCCTACGAGAAGAAGGTGCACAACGTGTGGGCCACCCACGCCTGCGTGCCCACCGACCCCAAC
CCCCAGGAGATGGTGCTGAAGAACGTGACCGAGAACTTCAACATGTGGAAGAACGACATGGTGGACCAGATGCA
CGAGGACGTGATCTCCCTGTGGGACCAGTCCCTGAAGCCCTGCGTGAAGCTGACCCCCCTGTGCGTGACCCTGA
ACTGCACCAACGCCACCGCCTCCAACTCCTCCATCATCGAGGGCATGAAGAACTGCTCCTTCAACATCACCACC
GAGCTGCGCGACAAGCGCGAGAAGAAGAACGCCCTGTTCTACAAGCTGGACATCGTGCAGCTGGACGGCAACTC
CTCCCAGTACCGCCTGATCAACTGCAACACCTCCGTGATCACCCAGGCCTGCCCCAAGGTGTCCTTCGACCCCA
TCCCCATCCACTACTGCGCCCCCGCCGGCTACGCCATCCTGAAGTGCAACAACAAGACCTTCACCGGCACCGGC
CCCTGCAACAACGTGTCCACCGTGCAGTGCACCCACGGCATCAAGCCCGTGGTGTCCACCCAGCTGCTGCTGAA
CGGCTCCCTGGCCGAGGGCGAGATCATCATCCGCTCCGAGAACATCACCGACAACGGCAAGACCATCATCGTGC
ACCTGAACGAGTCCGTGAAGATCGAGTGCACCCGCCCCAACAACAAGACCCGCACCTCCATCCGCATCGGCCCC
GGCCAGTGGTTCTACGCCACCGGCCAGGTGATCGGCGACATCCGCGAGGCCTACTGCAACATCAACGAGTCCAA
GTGGAACGAGACCCTGCAGCGCGTGTCCAAGAAGCTGAAGGAGTACTTCCCCCACAAGAACATCACCTTCCAGC
CCTCCTCCGGCGGCGACCTGGAGATCACCACCCACTCCTTCAACTGCGGCGGCGAGTTCTTCTACTGCAACACC
TCCTCCCTGTTCAACCGCACCTACATGGCCAACTCCACCGACATGGCCAACTCCACCGAGACCAACTCCACCCG
CACCATCACCATCCACTGCCGCATCAAGCAGATCATCAACATGTGGCAGGAGGTGGGCCGCGCCATGTACGCCC
CCCCCATCGCCGGCAACATCACCTGCATCTCCAACATCACCGGCCTGCTGCTGACCCGCGACGGCGGCAAGAAC
AACACCGAGACCTTCCGCCCCGGCGGCGGCAACATGAAGGACAACTGGCGCTCCGAGCTGTACAAGTACAAGGT
GGTGAAGATCGAGCCCCTGGGCGTGGCCCCCACCCGCTGCAAGCGCCGCGTGGTGGGCCGCCGCCGCCGCCGCC
GCGCCGTGGGCATCGGCGCCGTGTTCCTGGGCTTCCTGGGCGCCGCCGGCTCCACCATGGGCGCCGCCTCCATG
ACCCTGACCGTGCAGGCCCGCAACCTGCTGTCCGGCATCGTGCAGCAGCAGTCCAACCTGCTGCGCGCCCCCGA
GGCCCAGCAGCACCTGCTGAAGCTGACCGTGTGGGGCATCAAGCAGCTGCAGGCCCGCGTGCTGGCCGTGGAGC
GCTACCTGCGCGACCAGCAGCTGCTGGGCATCTGGGGCTGCTCCGGCAAGCTGATCTGCTGCACCAACGTGCCC
TGGAACTCCTCCTGGTCCAACCGCAACCTGTCCGAGATCTGGGACAACATGACCTGGCTGCAGTGGGACAAGGA
GATCTCCAACTACACCCAGATCATCTACGGCCTGCTGGAGGAGTCCCAGAACCAGCAGGAGAAGAACGAGCAGG
ACCTGCTGGCCCTGGACTAG

>HV1301298, CH505M11chim.6R.SOSIP.664v4.2 (SEQ ID NO. 206)
ATGCCCATGGGCTCCCTGCAGCCCCTGGCCACCCTGTACCTGCTGGGCATGCTGGTGGCCTCCGTGCTGGCCGC
CGAGAACCTGTGGGTGACCGTGTACTACGGCGTGCCCGTGTGGAAGGAGGCCAAGACCACCCTGTTCTGCGCCT
CCGACGCCAAGGCCTACGAGAAGGAGGTGCGCAACGTGTGGGCCACCCACGCCTGCGTGCCCACCGACCCCAAC
CCCCAGGAGATGGTGCTGAAGAACGTGACCGAGAACTTCAACATGTGGAAGAACGACATGGTGGACCAGATGCA
CGAGGACGTGATCTCCCTGTGGGACCAGTCCCTGAAGCCCTGCGTGAAGCTGACCCCCCTGTGCGTGACCCTGA
ACTGCACCAACGCCACCGCCTCCAACTCCTCCATCATCGAGGGCATGAAGAACTGCTCCTTCAACATCACCACC
GAGCTGCGCGACAAGCGCGAGAAGAAGAACGCCCTGTTCTACAAGCTGGACATCGTGCAGCTGGACGGCAACTC
CTCCCAGTACCGCCTGATCAACTGCAACACCTCCGTGATCACCCAGGCCTGCCCCAAGGTGTCCTTCGACCCCA
TCCCCATCCACTACTGCGCCCCCGCCGGCTACGCCATCCTGAAGTGCAACAACAAGACCTTCACCGGCACCGGC
CCCTGCAACAACGTGTCCACCGTGCAGTGCACCCACGGCATCAAGCCCGTGGTGTCCACCCAGCTGCTGCTGAA
CGGCTCCCTGGCCGAGGGCGAGATCATCATCCGCTCCGAGAACATCACCGACAACGGCAAGACCATCATCGTGC
ACCTGAACGAGTCCGTGAAGATCGAGTGCACCCGCCCCAACAACAAGACCCGCACCTCCATCCGCATCGGCCCC
GGCCAGTGGTTCTACGCCACCGGCCAGGTGATCGGCGACATCCGCGAGGCCTACTGCAACATCAACGAGTCCAA
GTGGAACGAGACCCTGCAGCGCGTGTCCAAGAAGCTGAAGGAGTACTTCCCCCACAAGAACATCACCTTCCAGC
CCTCCTCCGGCGGCGACCTGGAGATCACCACCCACTCCTTCAACTGCGGCGGCGAGTTCTTCTACTGCAACACC
TCCTCCCTGTTCAACCGCACCTACATGGCCAACTCCACCGACATGGCCAACTCCACCGAGACCAACTCCACCCG
CACCATCACCATCCACTGCCGCATCAAGCAGATCATCAACATGTGGCAGGAGGTGGGCCGCGCCATGTACGCCC
CCCCCATCGCCGGCAACATCACCTGCATCTCCAACATCACCGGCCTGCTGCTGACCCGCGACGGCGGCAAGAAC
AACACCGAGACCTTCCGCCCCGGCGGCGGCAACATGAAGGACAACTGGCGCTCCGAGCTGTACAAGTACAAGGT
GGTGAAGATCGAGCCCCTGGGCGTGGCCCCCACCCGCTGCAAGCGCCGCGTGGTGGGCCGCCGCCGCCGCCGCC
GCGCCGTGGGCATCGGCGCCGTGTTCCTGGGCTTCCTGGGCGCCGCCGGCTCCACCATGGGCGCCGCCTCCATG
ACCCTGACCGTGCAGGCCCGCAACCTGCTGTCCGGCATCGTGCAGCAGCAGTCCAACCTGCTGCGCGCCCCCGA
GGCCCAGCAGCACCTGCTGAAGCTGACCGTGTGGGGCATCAAGCAGCTGCAGGCCCGCGTGCTGGCCGTGGAGC
GC

Figure 22B cont.

TACCTGCGCGACCAGCAGCTGCTGGGCATCTGGGGCTGCTCCGGCAAGCTGATCTGCTGCACCAACGTGCCCTG
GAACTCCTCCTGGTCCAACCGCAACCTGTCCGAGATCTGGGACAACATGACCTGGCTGCAGTGGGACAAGGAGA
TCTCCAACTACACCCAGATCATCTACGGCCTGCTGGAGGAGTCCCAGAACCAGCAGGAGAAGAACGAGCAGGAC
CTGCTGGCCCTGGACTAG
>HV1301290, CH505w053.16.chim.6R.SOSIP.664v4.1 (SEQ ID NO. 207)
ATGCCCATGGGCTCCCTGCAGCCCCTGGCCACCCTGTACCTGCTGGGCATGCTGGTGGCCTCCGTGCTGGCCGC
CGAGAACCTGTGGGTGACCGTGTACTACGGCGTGCCCGTGTGGAAGGAGGCCAAGACCACCCTGTTCTGCGCCT
CCGACGCCAAGGCCTACGAGAAGAAGGTGCACAACGTGTGGGCCACCCACGCCTGCGTGCCCACCGACCCCAAC
CCCCAGGAGATGGTGCTGAAGAACGTGACCGAGAACTTCAACATGTGGAAGAACGACATGGTGGACCAGATGCA
CGAGGACGTGATCTCCCTGTGGGACCAGTCCCTGAAGCCCTGCGTGAAGCTGACCCCCCTGTGCGTGACCCTGA
ACTGCACCAACGCCAACGCCACCGCCTCCAACTCCTCCATCATCGAGGGCATGAACTCCTCCATCATCGAGGGC
ATGAAGAACTGCTCCTTCAACATCACCACCGAGCTGCGCGACAAGCGCGAGAAGAAGAACGCCCTGTTCTACAA
GCTGGACATCGTGCAGCTGGACGGCAACTCCTCCCAGTACCGCCTGATCAACTGCAACACCTCCGTGATCACCC
AGGCCTGCCCCAAGGTGTCCTTCGACCCCATCCCCATCCACTACTGCGCCCCCGCCGGCTACGCCATCCTGAAG
TGCAACAACAAGACCTTCAACGGCACCGGCCCCTGCAACAACGTGTCCACCGTGCAGTGCACCCACGGCATCAA
GCCCGTGGTGTCCACCCAGCTGCTGCTGAACGGCTCCCTGGCCGAGGGCGAGATCATCATCCGCTCCGAGAACA
TCACCGACAACGGCAAGACCATCATCGTGCACCTGAACGAGTCCGTGAAGATCGAGTGCACCCGCCCCTCCAAC
AACACCCGCACCTCCATCCGCATCGGCCCCGGCCAGTGGTTCTACGCCACCGGCCAGGTGATCGGCGACATCCG
CGAGGCCCACTGCAACATCTCCGAGTCCAAGTGGAACGAGACCCTGCAGCGCGTGTCCGAGAAGCTGAAGGAGT
ACTTCCCCCACAAGAACATCACCTTCCAGCCCTCCTCCGGCGGCGACCTGGAGATCACCACCCACTCCTTCAAC
TGCGGCGGCGAGTTCTTCTACTGCAACACCTCCTCCCTGTTCAACCGCACCTACATGGCCACCTCCACCGACAT
GGCCAACTCCACCGAGACCAACTCCACCCGCATCATCACCATCCGCTGCCGCATCAAGCAGATCATCAACATGT
GGCAGGAGGTGGGCCGCGCCATGTACGCCCCCCCCATCGCCGGCAACATCACCTGCATCTCCAACATCACCGGC
CTGCTGCTGACCCGCGACGGCGGCAAGAACAACACCGAGACCTTCGAGACCTTCCGCCCCGGCGGCGGCAACAT
GAAGGACAACTGGCGCTCCGAGCTGTACAAGTACAAGGTGGTGAAGATCGAGCCCCTGGGCGTGGCCCCCACCC
GCTGCAAGCGCCGCGTGGTGGGCCGCCGCCGCCGCCGCCGCGCCGTGGGCATCGGCGCCGTGTTCCTGGGCTTC
CTGGGCGCCGCCGGCTCCACCATGGGCGCCGCCTCCATGACCCTGACCGTGCAGGCCCGCAACCTGCTGTCCGG
CATCGTGCAGCAGCAGTCCAACCTGCTGCGCGCCCCCGAGGCCCAGCAGCACCTGCTGAAGCTGACCGTGTGGG
GCATCAAGCAGCTGCAGGCCCGCGTGCTGGCCGTGGAGCGCTACCTGCGCGACCAGCAGCTGCTGGGCATCTGG
GGCTGCTCCGGCAAGCTGATCTGCTGCACCAACGTGCCCTGGAACTCCTCCTGGTCCAACCGCAACCTGTCCGA
GATCTGGGACAACATGACCTGGCTGCAGTGGGACAAGGAGATCTCCAACTACACCCAGATCATCTACGGCCTGC
TGGAGGAGTCCCAGAACCAGCAGGAGAAGAACGAGCAGGACCTGCTGGCCCTGGACTAG
>HV1301299, CH505w053.16.chim.6R.SOSIP.664v4.2 (SEQ ID NO. 208)
ATGCCCATGGGCTCCCTGCAGCCCCTGGCCACCCTGTACCTGCTGGGCATGCTGGTGGCCTCCGTGCTGGCCGC
CGAGAACCTGTGGGTGACCGTGTACTACGGCGTGCCCGTGTGGAAGGAGGCCAAGACCACCCTGTTCTGCGCCT
CCGACGCCAAGGCCTACGAGAAGGAGGTGCGCAACGTGTGGGCCACCCACGCCTGCGTGCCCACCGACCCCAAC
CCCCAGGAGATGGTGCTGAAGAACGTGACCGAGAACTTCAACATGTGGAAGAACGACATGGTGGACCAGATGCA
CGAGGACGTGATCTCCCTGTGGGACCAGTCCCTGAAGCCCTGCGTGAAGCTGACCCCCCTGTGCGTGACCCTGA
ACTGCACCAACGCCAACGCCACCGCCTCCAACTCCTCCATCATCGAGGGCATGAACTCCTCCATCATCGAGGGC
ATGAAGAACTGCTCCTTCAACATCACCACCGAGCTGCGCGACAAGCGCGAGAAGAAGAACGCCCTGTTCTACAA
GCTGGACATCGTGCAGCTGGACGGCAACTCCTCCCAGTACCGCCTGATCAACTGCAACACCTCCGTGATCACCC
AGGCCTGCCCCAAGGTGTCCTTCGACCCCATCCCCATCCACTACTGCGCCCCCGCCGGCTACGCCATCCTGAAG
TGCAACAACAAGACCTTCAACGGCACCGGCCCCTGCAACAACGTGTCCACCGTGCAGTGCACCCACGGCATCAA
GCCCGTGGTGTCCACCCAGCTGCTGCTGAACGGCTCCCTGGCCGAGGGCGAGATCATCATCCGCTCCGAGAACA
TCACCGACAACGGCAAGACCATCATCGTGCACCTGAACGAGTCCGTGAAGATCGAGTGCACCCGCCCCTCCAAC
AACACCCGCACCTCCATCCGCATCGGCCCCGGCCAGTGGTTCTACGCCACCGGCCAGGTGATCGGCGACATCCG
CGAGGCCCACTGCAACATCTCCGAGTCCAAGTGGAACGAGACCCTGCAGCGCGTGTCCGAGAAGCTGAAGGAGT
ACTTCCCCCACAAGAACATCACCTTCCAGCCCTCCTCCGGCGGCGACCTGGAGATCACCACCCACTCCTTCAAC
TGCGGCGGCGAGTTCTTCTACTGCAACACCTCCTCCCTGTTCAACCGCACCTACATGGCCACCTCCACCGACAT
GGCCAACTCCACCGAGACCAACTCCACCCGCATCATCACCATCCGCTGCCGCATCAAGCAGATCATCAACATGT
GGCAGGAGGTGGGCCGCGCCATGTACGCCCCCCCCATCGCCGGCAACATCACCTGCATCTCCAACATCACCGGC
CTGCTGCTGACCCGCGACGGCGGCAAGAACAACACCGAGACCTTCGAGACCTTCCGCCCCGGCGGCGGCAACAT
GAAGGACAACTGGC

Figure 22B cont.

GCTCCGAGCTGTACAAGTACAAGGTGGTGAAGATCGAGCCCCTGGGCGTGGCCCCCACCCGCTGCAAGCGCCGC
GTGGTGGGCCGCCGCCGCCGCCGCCGCGCCGTGGGCATCGGCGCCGTGTTCCTGGGCTTCCTGGGCGCCGCCGG
CTCCACCATGGGCGCCGCCTCCATGACCCTGACCGTGCAGGCCCGCAACCTGCTGTCCGGCATCGTGCAGCAGC
AGTCCAACCTGCTGCGCGCCCCCGAGGCCCAGCAGCACCTGCTGAAGCTGACCGTGTGGGGCATCAAGCAGCTG
CAGGCCCGCGTGCTGGCCGTGGAGCGCTACCTGCGCGACCAGCAGCTGCTGGGCATCTGGGGCTGCTCCGGCAA
GCTGATCTGCTGCACCAACGTGCCCTGGAACTCCTCCTGGTCCAACCGCAACCTGTCCGAGATCTGGGACAACA
TGACCTGGCTGCAGTGGGACAAGGAGATCTCCAACTACACCCAGATCATCTACGGCCTGCTGGAGGAGTCCCAG
AACCAGCAGGAGAAGAACGAGCAGGACCTGCTGGCCCTGGACTAG

>HV1301291, CH505w078.33.chim.6R.SOSIP.664v4.1 (SEQ ID NO. 209)

ATGCCCATGGGCTCCCTGCAGCCCCTGGCCACCCTGTACCTGCTGGGCATGCTGGTGGCCTCCGTGCTGGCCGC
CGAGAACCTGTGGGTGACCGTGTACTACGGCGTGCCCGTGTGGAAGGAGGCCAAGACCACCCTGTTCTGCGCCT
CCGACGCCAAGGCCTACGAGAAGAAGGTGCACAACGTGTGGGCCACCCACGCCTGCGTGCCCACCGACCCCAAC
CCCCAGGAGATGGTGCTGAAGAACGTGACCGAGAACTTCAACATGTGGAAGAACGACATGGCCGACCAGATGCA
CGAGGACGTGATCTCCCTGTGGGACCAGTCCCTGAAGCCCTGCGTGAAGCTGACCCCCCTGTGCGTGACCCTGA
ACTGCATCGACGCCAACGCCACCGCCTCCAACGCCACCGCCTCCAACTCCTCCATCATCGAGGGCATGAAGAAC
TGCTCCTTCAACATCACCACCGAGCTGCGCGACAAGATCGAGAAGAAGAACGCCCTGTTCTACAAGCTGGACAT
CGTGCAGCTGGACGGCAACTCCTCCCAGTACCGCCTGATCAACTGCAACACCTCCGTGATCACCCAGGCCTGCC
CCAAGGTGTCCTTCGACCCCATCCCCATCCACTACTGCGCCCCCGCCGGCTACGCCATCCTGAAGTGCAACAAC
AAGACCTTCAACGGCACCGGCCCCTGCAACAACGTGTCCACCGTGCAGTGCACCCACGGCATCAAGCCCGTGGT
GTCCACCCAGCTGCTGCTGAACGGCTCCCTGGCCGAGGGCGAGATCATCATCCGCTCCGAGAACATCACCAACT
CCGCCAAGACCATCATCGTGCACCTGAACGAGTCCGTGAAGATCGAGTGCACCCGCCCCTCCAACAACACCCGC
ACCTCCATCCGCATCGGCCCCGGCCAGTGGTTCTACGCCACCGGCCAGGTGATCGGCGACATCCGCAAGGCCCA
CTGCAACATCTCCGAGTCCAAGTGGAACGAGACCCTGCAGCGCGTGTCCAAGAAGCTGAAGGAGTACTTCCCCC
ACAAGAACATCACCTTCCAGCCCTCCTCCGGCGGCGACCTGGAGATCACCACCCACTCCTTCAACTGCGGCGGC
GAGTTCTTCTACTGCAACACCTCCTCCCTGTTCAACCGCACCTACATGGCCAACTCCACCGAGACCAACTCCAC
CCGCACCATCACCCTGCACTGCCGCATCAAGCAGATCATCAACATGTGGCAGGAGGTGGGCCGCGCCATGTACG
CCCCCCCCATCGCCGGCAACATCACCTGCATCTCCAACATCACCGGCCTGCTGCTGACCCGCGACGGCGGCAAC
AACAACACCACCGAGACCTTCCGCCCCGGCGGCGGCAACATGAAGGACAACTGGCGCTCCGAGCTGTACAAGTA
CAAGGTGGTGAAGATCGAGCCCCTGGGCGTGGCCCCCACCCGCTGCAAGCGCCGCGTGGTGGGCCGCCGCCGCC
GCCGCCGCGCCGTGGGCATCGGCGCCGTGTTCCTGGGCTTCCTGGGCGCCGCCGGCTCCACCATGGGCGCCGCC
TCCATGACCCTGACCGTGCAGGCCCGCAACCTGCTGTCCGGCATCGTGCAGCAGCAGTCCAACCTGCTGCGCGC
CCCCGAGGCCCAGCAGCACCTGCTGAAGCTGACCGTGTGGGGCATCAAGCAGCTGCAGGCCCGCGTGCTGGCCG
TGGAGCGCTACCTGCGCGACCAGCAGCTGCTGGGCATCTGGGGCTGCTCCGGCAAGCTGATCTGCTGCACCAAC
GTGCCCTGGAACTCCTCCTGGTCCAACCGCAACCTGTCCGAGATCTGGGACAACATGACCTGGCTGCAGTGGGA
CAAGGAGATCTCCAACTACACCCAGATCATCTACGGCCTGCTGGAGGAGTCCCAGAACCAGCAGGAGAAGAACG
AGCAGGACCTGCTGGCCCTGGACTAG

>HV1301300, CH505w078.33.chim.6R.SOSIP.664v4.2 (SEQ ID NO. 210)

ATGCCCATGGGCTCCCTGCAGCCCCTGGCCACCCTGTACCTGCTGGGCATGCTGGTGGCCTCCGTGCTGGCCGC
CGAGAACCTGTGGGTGACCGTGTACTACGGCGTGCCCGTGTGGAAGGAGGCCAAGACCACCCTGTTCTGCGCCT
CCGACGCCAAGGCCTACGAGAAGGAGGTGCGCAACGTGTGGGCCACCCACGCCTGCGTGCCCACCGACCCCAAC
CCCCAGGAGATGGTGCTGAAGAACGTGACCGAGAACTTCAACATGTGGAAGAACGACATGGCCGACCAGATGCA
CGAGGACGTGATCTCCCTGTGGGACCAGTCCCTGAAGCCCTGCGTGAAGCTGACCCCCCTGTGCGTGACCCTGA
ACTGCATCGACGCCAACGCCACCGCCTCCAACGCCACCGCCTCCAACTCCTCCATCATCGAGGGCATGAAGAAC
TGCTCCTTCAACATCACCACCGAGCTGCGCGACAAGATCGAGAAGAAGAACGCCCTGTTCTACAAGCTGGACAT
CGTGCAGCTGGACGGCAACTCCTCCCAGTACCGCCTGATCAACTGCAACACCTCCGTGATCACCCAGGCCTGCC
CCAAGGTGTCCTTCGACCCCATCCCCATCCACTACTGCGCCCCCGCCGGCTACGCCATCCTGAAGTGCAACAAC
AAGACCTTCAACGGCACCGGCCCCTGCAACAACGTGTCCACCGTGCAGTGCACCCACGGCATCAAGCCCGTGGT
GTCCACCCAGCTGCTGCTGAACGGCTCCCTGGCCGAGGGCGAGATCATCATCCGCTCCGAGAACATCACCAACT
CCGCCAAGACCATCATCGTGCACCTGAACGAGTCCGTGAAGATCGAGTGCACCCGCCCCTCCAACAACACCCGC
ACCTCCATCCGCATCGGCCCCGGCCAGTGGTTCTACGCCACCGGCCAGGTGATCGGCGACATCCGCAAGGCCCA
CTGCAACATCTCCGAGTCCAAGTGGAACGAGACCCTGCAGCGCGTGTCCAAGAAGCTGAAGGAGTACTTCCCCC
ACAAGAACATCACCTTCCAGCCCTCCTCCGGCGGCGACCTGGAGATCACCACCCACTCCTTCAACTGCGGCGGC
GAGTTCTTCTACTGCAACACCTCCTC

Figure 22B cont.

CCTGTTCAACCGCACCTACATGGCCAACTCCACCGAGACCAACTCCACCCGCACCATCACCCTGCACTGCCGCA
TCAAGCAGATCATCAACATGTGGCAGGAGGTGGGCCGCGCCATGTACGCCCCCCCCATCGCCGGCAACATCACC
TGCATCTCCAACATCACCGGCCTGCTGCTGACCCGCGACGGCGGCAACAACAACACCACCGAGACCTTCCGCCC
CGGCGGCGGCAACATGAAGGACAACTGGCGCTCCGAGCTGTACAAGTACAAGGTGGTGAAGATCGAGCCCCTGG
GCGTGGCCCCCACCCGCTGCAAGCGCCGCGTGGTGGGCCGCCGCCGCCGCCGCCGCGCCGTGGGCATCGGCGCC
GTGTTCCTGGGCTTCCTGGGCGCCGCCGGCTCCACCATGGGCGCCGCCTCCATGACCCTGACCGTGCAGGCCCG
CAACCTGCTGTCCGGCATCGTGCAGCAGCAGTCCAACCTGCTGCGCGCCCCCGAGGCCCAGCAGCACCTGCTGA
AGCTGACCGTGTGGGGCATCAAGCAGCTGCAGGCCCGCGTGCTGGCCGTGGAGCGCTACCTGCGCGACCAGCAG
CTGCTGGGCATCTGGGGCTGCTCCGGCAAGCTGATCTGCTGCACCAACGTGCCCTGGAACTCCTCCTGGTCCAA
CCGCAACCTGTCCGAGATCTGGGACAACATGACCTGGCTGCAGTGGGACAAGGAGATCTCCAACTACACCCAGA
TCATCTACGGCCTGCTGGAGGAGTCCCAGAACCAGCAGGAGAAGAACGAGCAGGACCTGCTGGCCCTGGACTAG
>HV1301292, CH505w100.B6chim.6R.SOSIP.664v4.1 (SEQ ID NO. 211)
ATGCCCATGGGCTCCCTGCAGCCCCTGGCCACCCTGTACCTGCTGGGCATGCTGGTGGCCTCCGTGCTGGCCGC
CGAGAACCTGTGGGTGACCGTGTACTACGGCGTGCCCGTGTGGAAGGAGGCCAAGACCACCCTGTTCTGCGCCT
CCGACGCCAAGGCCTACGAGAAGAAGGTGCACAACGTGTGGGCCACCCACGCCTGCGTGCCCACCGACCCCAAC
CCCCAGGAGATGGTGCTGGAGAACGTGACCGAGAACTTCAACATGTGGAAGAACGACATGGCCGACCAGATGCA
CGAGGACGTGATCTCCCTGTGGGACCAGTCCCTGAAGCCCTGCGTGAAGCTGACCCCCCTGTGCGTGACCCTGA
ACTGCACCGACGCCAACGCCACCGCCTCCAACACCAACGCCACCGCCTCCAACATCAACGCCACCGCCTCCAAG
TCCTCCATCATCGAGGAGATGAAGAACTGCTCCTTCAACATCACCACCGAGCTGCGCGACAAGCGCGAGAAGAA
GTACGCCCTGTTCTACAAGCTGGACATCGTGCAGCTGGACGGCAACTCCTCCCAGTACCGCCTGATCAACTGCA
ACACCTCCGTGATCACCCAGGCCTGCCCCAAGGTGTCCTTCGACCCCATCCCCATCCACTACTGCGCCCCCGCC
GGCTACGCCATCCTGAAGTGCAACAACAAGACCTTCAACGGCACCGGCCCCTGCAACAACGTGTCCACCGTGCA
GTGCACCCACGGCATCAAGCCCGTGGTGTCCACCCAGCTGCTGCTGAACGGCTCCCTGGCCGAGGGCGAGATCA
TCATCCGCTCCGAGAACATCACCGACAACTCCAAGACCATCATCGTGCACCTGAACGAGTCCGTGAAGATCGAG
TGCACCCGCCCCTCCAACAACACCCGCACCTCCATCCGCATCGGCCCCGGCCAGTGGTTCTACGCCACCGGCCA
GGTGATCGGCGACATCCGCGAGGCCCACTGCAACATCTCCGAGTCCAAGTGGAACGAGACCCTGCAGCGCGTGT
CCAAGAAGCTGAAGGAGTACTTCCCCGACAAGAACATCACCTTCCAGCCCTCCTCCGGCGGCGACCCCGAGATC
ACCACCCACTCCTTCAACTGCGGCGGCGAGTTCTTCTACTGCAACACCTCCTCCCTGTTCAACCGCACCTACAT
GGCCAACTCCACCGAGACCAACTCCACCCGCACCATCACCCTGCACTGCCGCATCAAGCAGATCATCAACATGT
GGCAGGAGGTGGGCCGCGCCATGTACGCCCCCCCCATCGCCGGCAACATCACCTGCATCTCCAACATCACCGGC
CTGCTGCTGACCCGCGACGGCGGCGAGAACACCCGCGACGGCGGCAACAACAACACCGAGACCTTCCGCCCCGA
GGGCGGCAACATGAAGGACAACTGGCGCTCCGAGCTGTACAAGTACAAGGTGGTGAAGATCGAGCCCCTGGGCG
TGGCCCCCACCCGCTGCAAGCGCCGCGTGGTGGGCCGCCGCCGCCGCCGCCGCGCCGTGGGCATCGGCGCCGTG
TTCCTGGGCTTCCTGGGCGCCGCCGGCTCCACCATGGGCGCCGCCTCCATGACCCTGACCGTGCAGGCCCGCAA
CCTGCTGTCCGGCATCGTGCAGCAGCAGTCCAACCTGCTGCGCGCCCCCGAGGCCCAGCAGCACCTGCTGAAGC
TGACCGTGTGGGGCATCAAGCAGCTGCAGGCCCGCGTGCTGGCCGTGGAGCGCTACCTGCGCGACCAGCAGCTG
CTGGGCATCTGGGGCTGCTCCGGCAAGCTGATCTGCTGCACCAACGTGCCCTGGAACTCCTCCTGGTCCAACCG
CAACCTGTCCGAGATCTGGGACAACATGACCTGGCTGCAGTGGGACAAGGAGATCTCCAACTACACCCAGATCA
TCTACGGCCTGCTGGAGGAGTCCCAGAACCAGCAGGAGAAGAACGAGCAGGACCTGCTGGCCCTGGACTAG
>HV1301301, CH505w100.B6chim.6R.SOSIP.664v4.2 (SEQ ID NO. 212)
ATGCCCATGGGCTCCCTGCAGCCCCTGGCCACCCTGTACCTGCTGGGCATGCTGGTGGCCTCCGTGCTGGCCGC
CGAGAACCTGTGGGTGACCGTGTACTACGGCGTGCCCGTGTGGAAGGAGGCCAAGACCACCCTGTTCTGCGCCT
CCGACGCCAAGGCCTACGAGAAGGAGGTGCGCAACGTGTGGGCCACCCACGCCTGCGTGCCCACCGACCCCAAC
CCCCAGGAGATGGTGCTGGAGAACGTGACCGAGAACTTCAACATGTGGAAGAACGACATGGCCGACCAGATGCA
CGAGGACGTGATCTCCCTGTGGGACCAGTCCCTGAAGCCCTGCGTGAAGCTGACCCCCCTGTGCGTGACCCTGA
ACTGCACCGACGCCAACGCCACCGCCTCCAACACCAACGCCACCGCCTCCAACATCAACGCCACCGCCTCCAAG
TCCTCCATCATCGAGGAGATGAAGAACTGCTCCTTCAACATCACCACCGAGCTGCGCGACAAGCGCGAGAAGAA
GTACGCCCTGTTCTACAAGCTGGACATCGTGCAGCTGGACGGCAACTCCTCCCAGTACCGCCTGATCAACTGCA
ACACCTCCGTGATCACCCAGGCCTGCCCCAAGGTGTCCTTCGACCCCATCCCCATCCACTACTGCGCCCCCGCC
GGCTACGCCATCCTGAAGTGCAACAACAAGACCTTCAACGGCACCGGCCCCTGCAACAACGTGTCCACCGTGCA
GTGCACCCACGGCATCAAGCCCGTGGTGTCCACCCAGCTGC

Figure 22B cont.

TGCTGAACGGCTCCCTGGCCGAGGGCGAGATCATCATCCGCTCCGAGAACATCACCGACAACTCCAAGACCATC
ATCGTGCACCTGAACGAGTCCGTGAAGATCGAGTGCACCCGCCCCTCCAACAACACCCGCACCTCCATCCGCAT
CGGCCCCGGCCAGTGGTTCTACGCCACCGGCCAGGTGATCGGCGACATCCGCGAGGCCCACTGCAACATCTCCG
AGTCCAAGTGGAACGAGACCCTGCAGCGCGTGTCCAAGAAGCTGAAGGAGTACTTCCCCGACAAGAACATCACC
TTCCAGCCCTCCTCCGGCGGCGACCCCGAGATCACCACCCACTCCTTCAACTGCGGCGGCGAGTTCTTCTACTG
CAACACCTCCTCCCTGTTCAACCGCACCTACATGGCCAACTCCACCGAGACCAACTCCACCCGCACCATCACCC
TGCACTGCCGCATCAAGCAGATCATCAACATGTGGCAGGAGGTGGGCCGCGCCATGTACGCCCCCCCCATCGCC
GGCAACATCACCTGCATCTCCAACATCACCGGCCTGCTGCTGACCCGCGACGGCGGCGAGAACACCCGCGACGG
CGGCAACAACAACACCGAGACCTTCCGCCCCGAGGGCGGCAACATGAAGGACAACTGGCGCTCCGAGCTGTACA
AGTACAAGGTGGTGAAGATCGAGCCCCTGGGCGTGGCCCCCACCCGCTGCAAGCGCCGCGTGGTGGGCCGCCGC
CGCCGCCGCCGCGCCGTGGGCATCGGCGCCGTGTTCCTGGGCTTCCTGGGCGCCGCCGGCTCCACCATGGGCGC
CGCCTCCATGACCCTGACCGTGCAGGCCCGCAACCTGCTGTCCGGCATCGTGCAGCAGCAGTCCAACCTGCTGC
GCGCCCCCGAGGCCCAGCAGCACCTGCTGAAGCTGACCGTGTGGGGCATCAAGCAGCTGCAGGCCCGCGTGCTG
GCCGTGGAGCGCTACCTGCGCGACCAGCAGCTGCTGGGCATCTGGGGCTGCTCCGGCAAGCTGATCTGCTGCAC
CAACGTGCCCTGGAACTCCTCCTGGTCCAACCGCAACCTGTCCGAGATCTGGGACAACATGACCTGGCTGCAGT
GGGACAAGGAGATCTCCAACTACACCCAGATCATCTACGGCCTGCTGGAGGAGTCCCAGAACCAGCAGGAGAAG
AACGAGCAGGACCTGCTGGCCCTGGACTAG
>HV1301293, CH505w136.B18chim.6R.SOSIP.664v4.1 (SEQ ID NO. 213)
ATGCCCATGGGCTCCCTGCAGCCCCTGGCCACCCTGTACCTGCTGGGCATGCTGGTGGCCTCCGTGCTGGCCGC
CGAGAACCTGTGGGTGACCGTGTACTACGGCGTGCCCGTGTGGAAGGAGGCCAAGACCACCCTGTTCTGCGCCT
CCGACGCCAAGGCCTACGAGAAGAAGGTGCACAACGTGTGGGCCACCCACGCCTGCGTGCCCACCGACCCCAAC
CCCCAGGAGATGGTGCTGAAGAACGTGACCGAGAACTTCAACATGTGGAAGAACGACATGGTGGACCAGATGCA
CGAGGACGTGATCTCCCTGTGGGACCAGTCCCTGACCCCCTGCGTGAAGCTGACCCCCCTGTGCGTGACCCTGA
ACTGCACCGACGCCAACGACACCGCCTCCAACTCCTCCATCATCAAGGGCATGAACAACTCCATCGTGGGCGAG
ATGAAGAACTGCTCCTTCAACATCACCACCGAGCTGCGCGACAAGCGCGAGAAGAAGAACGCCCTGTTCTACAA
GCTGGACATCGTGCAGCTGGACGGCAACTCCTCCGAGTACCGCCTGATCAACTGCAACACCTCCGTGATCACCC
AGGCCTGCCCCAAGGTGTCCTTCGACCCCATCCCCATCCACTACTGCGCCCCCGCCGGCTACGCCATCCTGAAG
TGCAACAACAAGACCTTCAACGGCACCGGCCCCTGCAACAACGTGTCCACCGTGCAGTGCACCCACGGCATCAA
GCCCGTGGTGTCCACCCAGCTGCTGCTGAACGGCTCCCTGGCCGAGGGCGAGATCATCATCCGCTCCGAGAACA
TCACCGACAACGCCAAGACCATCATCGTGCACCTGAACGAGTCCGTGAAGATCGAGTGCACCCGCCCCTCCAAC
AACACCCGCACCTCCATCCGCATCGGCCCCGGCCAGTGGTTCTACGCCACCGGCCAGGTGATCGGCGACATCCG
CAAGGCCCACTGCAACATCTCCGAGTCCAAGTGGAACGAGACCCTGCAGCGCGTGTCCAAGAAGCTGAAGGAGT
ACTTCCCCGACAAGAACATCACCTTCCAGCCCTCCTCCGGCGGCGACCCCGAGATCACCACCCACTCCTTCAAC
TGCGGCGGCGAGTTCTTCTACTGCAACACCTCCTCCCTGTTCAACCGCACCTACATGGCCAACTCCACCGACAT
GGCCAACTCCGCCGAGACCAACTCCACCCGCACCATCACCCTGCACTGCCGCATCAAGCAGATCATCAACATGT
GGCAGGAGGTGGGCCGCGCCATGTACGCCCCCCCCATCGCCGGCAACATCACCTGCATCTCCAACATCACCGGC
CTGCTGCTGACCCGCGACGGCGGCAACTCCTCCACCGAGACCGAGACCTTCCGCCCCGGCGGCGGCAACATGAA
GGACAACTGGCGCTCCGAGCTGTACAAGTACAAGGTGGTGAAGATCGAGCCCCTGGGCGTGGCCCCCACCCGCT
GCAAGCGCCGCGTGGTGGGCCGCCGCCGCCGCCGCCGCGCCGTGGGCATCGGCGCCGTGTTCCTGGGCTTCCTG
GGCGCCGCCGGCTCCACCATGGGCGCCGCCTCCATGACCCTGACCGTGCAGGCCCGCAACCTGCTGTCCGGCAT
CGTGCAGCAGCAGTCCAACCTGCTGCGCGCCCCCGAGGCCCAGCAGCACCTGCTGAAGCTGACCGTGTGGGGCA
TCAAGCAGCTGCAGGCCCGCGTGCTGGCCGTGGAGCGCTACCTGCGCGACCAGCAGCTGCTGGGCATCTGGGGC
TGCTCCGGCAAGCTGATCTGCTGCACCAACGTGCCCTGGAACTCCTCCTGGTCCAACCGCAACCTGTCCGAGAT
CTGGGACAACATGACCTGGCTGCAGTGGGACAAGGAGATCTCCAACTACACCCAGATCATCTACGGCCTGCTGG
AGGAGTCCCAGAACCAGCAGGAGAAGAACGAGCAGGACCTGCTGGCCCTGGACTAG
>HV1301302, CH505w136.B18chim.6R.SOSIP.664v4.2 (SEQ ID NO. 214)
ATGCCCATGGGCTCCCTGCAGCCCCTGGCCACCCTGTACCTGCTGGGCATGCTGGTGGCCTCCGTGCTGGCCGC
CGAGAACCTGTGGGTGACCGTGTACTACGGCGTGCCCGTGTGGAAGGAGGCCAAGACCACCCTGTTCTGCGCCT
CCGACGCCAAGGCCTACGAGAAGGAGGTGCGCAACGTGTGGGCCACCCACGCCTGCGTGCCCACCGACCCCAAC
CCCCAGGAGATGGTGCTGAAGAACGTGACCGAGAACTTCAACATGTGGAAGAACGACATGGTGGACCAGATGCA
CGAGGACGTGATCTCCCTGTGGGACCAGTCCCTGACCCCCTGCGTGAAGCTGACCCCCCTGTGCGTGACCCTGA
ACTGCACCGACGCCAACGACACCGCCTCCAACTCCTCCATCATCAAGGGCATGAAC

Figure 22B cont.

AACTCCATCGTGGGCGAGATGAAGAACTGCTCCTTCAACATCACCACCGAGCTGCGCGACAAGCGCGAGAAGAA
GAACGCCCTGTTCTACAAGCTGGACATCGTGCAGCTGGACGGCAACTCCTCCGAGTACCGCCTGATCAACTGCA
ACACCTCCGTGATCACCCAGGCCTGCCCCAAGGTGTCCTTCGACCCCATCCCCATCCACTACTGCGCCCCCGCC
GGCTACGCCATCCTGAAGTGCAACAACAAGACCTTCAACGGCACCGGCCCCTGCAACAACGTGTCCACCGTGCA
GTGCACCCACGGCATCAAGCCCGTGGTGTCCACCCAGCTGCTGCTGAACGGCTCCCTGGCCGAGGGCGAGATCA
TCATCCGCTCCGAGAACATCACCGACAACGCCAAGACCATCATCGTGCACCTGAACGAGTCCGTGAAGATCGAG
TGCACCCGCCCCTCCAACAACACCCGCACCTCCATCCGCATCGGCCCCGGCCAGTGGTTCTACGCCACCGGCCA
GGTGATCGGCGACATCCGCAAGGCCCACTGCAACATCTCCGAGTCCAAGTGGAACGAGACCCTGCAGCGCGTGT
CCAAGAAGCTGAAGGAGTACTTCCCCGACAAGAACATCACCTTCCAGCCCTCCTCCGGCGGCGACCCCGAGATC
ACCACCCACTCCTTCAACTGCGGCGGCGAGTTCTTCTACTGCAACACCTCCTCCCTGTTCAACCGCACCTACAT
GGCCAACTCCACCGACATGGCCAACTCCGCCGAGACCAACTCCACCCGCACCATCACCCTGCACTGCCGCATCA
AGCAGATCATCAACATGTGGCAGGAGGTGGGCCGCGCCATGTACGCCCCCCCCATCGCCGGCAACATCACCTGC
ATCTCCAACATCACCGGCCTGCTGCTGACCCGCGACGGCGGCAACTCCTCCACCGAGACCGAGACCTTCCGCCC
CGGCGGCGGCAACATGAAGGACAACTGGCGCTCCGAGCTGTACAAGTACAAGGTGGTGAAGATCGAGCCCCTGG
GCGTGGCCCCCACCCGCTGCAAGCGCCGCGTGGTGGGCCGCCGCCGCCGCCGCCGCGCCGTGGGCATCGGCGCC
GTGTTCCTGGGCTTCCTGGGCGCCGCCGGCTCCACCATGGGCGCCGCCTCCATGACCCTGACCGTGCAGGCCCG
CAACCTGCTGTCCGGCATCGTGCAGCAGCAGTCCAACCTGCTGCGCGCCCCCGAGGCCCAGCAGCACCTGCTGA
AGCTGACCGTGTGGGGCATCAAGCAGCTGCAGGCCCGCGTGCTGGCCGTGGAGCGCTACCTGCGCGACCAGCAG
CTGCTGGGCATCTGGGGCTGCTCCGGCAAGCTGATCTGCTGCACCAACGTGCCCTGGAACTCCTCCTGGTCCAA
CCGCAACCTGTCCGAGATCTGGGACAACATGACCTGGCTGCAGTGGGACAAGGAGATCTCCAACTACACCCAGA
TCATCTACGGCCTGCTGGAGGAGTCCCAGAACCAGCAGGAGAAGAACGAGCAGGACCTGCTGGCCCTGGACTAG
>HV1301294, CH505w20.14chim.6R.SOSIP.664v4.1 (SEQ ID NO. 215)
ATGCCCATGGGCTCCCTGCAGCCCCTGGCCACCCTGTACCTGCTGGGCATGCTGGTGGCCTCCGTGCTGGCCGC
CGAGAACCTGTGGGTGACCGTGTACTACGGCGTGCCCGTGTGGAAGGAGGCCAAGACCACCCTGTTCTGCGCCT
CCGACGCCAAGGCCTACGAGAAGAAGGTGCACAACGTGTGGGCCACCCACGCCTGCGTGCCCACCGACCCCAAC
CCCCAGGAGATGGTGCTGAAGAACGTGACCGAGAACTTCAACATGTGGAAGAACGACATGGTGGACCAGATGCA
CGAGGACGTGATCTCCCTGTGGGACCAGTCCCTGAAGCCCTGCGTGAAGCTGACCCCCCTGTGCGTGACCCTGA
ACTGCACCAACGCCACCGCCTCCAACAACTCCATCATCGAGGGCATGAAGAACTGCTCCTTCAACATCACCACC
GAGCTGCGCGACAAGCGCGAGAAGAAGAACGCCCTGTTCTACAAGCTGGACATCGTGCAGCTGGACGGCAACTC
CTCCCAGTACCGCCTGATCAACTGCAACACCTCCGTGATCACCCAGGCCTGCCCCAAGGTGTCCTTCGACCCCA
TCCCCATCCACTACTGCGCCCCCGCCGGCTACGCCATCCTGAAGTGCAACAACAAGACCTTCACCGGCACCGGC
CCCTGCAACAACGTGTCCACCGTGCAGTGCACCCACGGCATCAAGCCCGTGGTGTCCACCCAGCTGCTGCTGAA
CGGCTCCCTGGCCGAGGGCGAGATCATCATCCGCTCCGAGAACATCACCAACAACGCCAAGACCATCATCGTGC
ACCTGAACGAGTCCGTGAAGATCGAGTGCACCCGCCCCAACAACAAGACCCGCACCTCCATCCGCATCGGCCCC
GGCCAGTGGTTCTACGCCACCGGCCAGGTGATCGGCGACATCCGCAAGGCCTACTGCAACATCTCCGAGTCCAA
GTGGAACGAGACCCTGCAGCGCGTGTCCAAGAAGCTGAAGGAGTACTTCCCCCACAAGAACATCACCTTCCAGC
CCTCCTCCGGCGGCGACCTGGAGATCACCACCCACTCCTTCAACTGCGGCGGCGAGTTCTTCTACTGCAACACC
TCCTCCCTGTTCAACCGCACCTACATGGCCAACTCCACCGACATGGCCAACTCCACCGAGACCAACTCCACCCG
CACCATCACCCTGCACTGCCGCATCAAGCAGATCATCAACATGTGGCAGGAGGTGGGCCGCGCCATGTACGCCC
CCCCCATCGCCGGCAACATCACCTGCATCTCCAACATCACCGGCCTGCTGCTGACCCGCGACGGCGGCAAGAAC
AACACCGAGACCTTCCGCCCCGGCGGCGGCAACATGAAGGACAACTGGCGCTCCGAGCTGTACAAGTACAAGGT
GGTGAAGATCGAGCCCCTGGGCGTGGCCCCCACCCGCTGCAAGCGCCGCGTGGTGGGCCGCCGCCGCCGCCGCC
GCGCCGTGGGCATCGGCGCCGTGTTCCTGGGCTTCCTGGGCGCCGCCGGCTCCACCATGGGCGCCGCCTCCATG
ACCCTGACCGTGCAGGCCCGCAACCTGCTGTCCGGCATCGTGCAGCAGCAGTCCAACCTGCTGCGCGCCCCCGA
GGCCCAGCAGCACCTGCTGAAGCTGACCGTGTGGGGCATCAAGCAGCTGCAGGCCCGCGTGCTGGCCGTGGAGC
GCTACCTGCGCGACCAGCAGCTGCTGGGCATCTGGGGCTGCTCCGGCAAGCTGATCTGCTGCACCAACGTGCCC
TGGAACTCCTCCTGGTCCAACCGCAACCTGTCCGAGATCTGGGACAACATGACCTGGCTGCAGTGGGACAAGGA
GATCTCCAACTACACCCAGATCATCTACGGCCTGCTGGAGGAGTCCCAGAACCAGCAGGAGAAGAACGAGCAGG
ACCTGCTGGCCCTGGACTAG

Figure 22B cont.

>HV1301303, CH505w20.14chim.6R.SOSIP.664v4.2 (SEQ ID NO. 216)
ATGCCCATGGGCTCCCTGCAGCCCCTGGCCACCCTGTACCTGCTGGGCATGCTGGTGGCCTCCGTGCTGGC
CGCCGAGAACCTGTGGGTGACCGTGTACTACGGCGTGCCCGTGTGGAAGGAGGCCAAGACCACCCTGTTCTGCG
CCTCCGACGCCAAGGCCTACGAGAAGGAGGTGCGCAACGTGTGGGCCACCCACGCCTGCGTGCCCACCGACCCC
AACCCCCAGGAGATGGTGCTGAAGAACGTGACCGAGAACTTCAACATGTGGAAGAACGACATGGTGGACCAGAT
GCACGAGGACGTGATCTCCCTGTGGGACCAGTCCCTGAAGCCCTGCGTGAAGCTGACCCCCCTGTGCGTGACCC
TGAACTGCACCAACGCCACCGCCTCCAACAACTCCATCATCGAGGGCATGAAGAACTGCTCCTTCAACATCACC
ACCGAGCTGCGCGACAAGCGCGAGAAGAAGAACGCCCTGTTCTACAAGCTGGACATCGTGCAGCTGGACGGCAA
CTCCTCCCAGTACCGCCTGATCAACTGCAACACCTCCGTGATCACCCAGGCCTGCCCCAAGGTGTCCTTCGACC
CCATCCCCATCCACTACTGCGCCCCCGCCGGCTACGCCATCCTGAAGTGCAACAACAAGACCTTCACCGGCACC
GGCCCCTGCAACAACGTGTCCACCGTGCAGTGCACCCACGGCATCAAGCCCGTGGTGTCCACCCAGCTGCTGCT
GAACGGCTCCCTGGCCGAGGGCGAGATCATCATCCGCTCCGAGAACATCACCAACAACGCCAAGACCATCATCG
TGCACCTGAACGAGTCCGTGAAGATCGAGTGCACCCGCCCCAACAACAAGACCCGCACCTCCATCCGCATCGGC
CCCGGCCAGTGGTTCTACGCCACCGGCCAGGTGATCGGCGACATCCGCAAGGCCTACTGCAACATCTCCGAGTC
CAAGTGGAACGAGACCCTGCAGCGCGTGTCCAAGAAGCTGAAGGAGTACTTCCCCCACAAGAACATCACCTTCC
AGCCCTCCTCCGGCGGCGACCTGGAGATCACCACCCACTCCTTCAACTGCGGCGGCGAGTTCTTCTACTGCAAC
ACCTCCTCCCTGTTCAACCGCACCTACATGGCCAACTCCACCGACATGGCCAACTCCACCGAGACCAACTCCAC
CCGCACCATCACCCTGCACTGCCGCATCAAGCAGATCATCAACATGTGGCAGGAGGTGGGCCGCGCCATGTACG
CCCCCCCCATCGCCGGCAACATCACCTGCATCTCCAACATCACCGGCCTGCTGCTGACCCGCGACGGCGGCAAG
AACAACACCGAGACCTTCCGCCCCGGCGGCGGCAACATGAAGGACAACTGGCGCTCCGAGCTGTACAAGTACAA
GGTGGTGAAGATCGAGCCCCTGGGCGTGGCCCCCACCCGCTGCAAGCGCCGCGTGGTGGGCCGCCGCCGCCGCC
GCCGCGCCGTGGGCATCGGCGCCGTGTTCCTGGGCTTCCTGGGCGCCGCCGGCTCCACCATGGGCGCCGCCTCC
ATGACCCTGACCGTGCAGGCCCGCAACCTGCTGTCCGGCATCGTGCAGCAGCAGTCCAACCTGCTGCGCGCCCC
CGAGGCCCAGCAGCACCTGCTGAAGCTGACCGTGTGGGGCATCAAGCAGCTGCAGGCCCGCGTGCTGGCCGTGG
AGCGCTACCTGCGCGACCAGCAGCTGCTGGGCATCTGGGGCTGCTCCGGCAAGCTGATCTGCTGCACCAACGTG
CCCTGGAACTCCTCCTGGTCCAACCGCAACCTGTCCGAGATCTGGGACAACATGACCTGGCTGCAGTGGGACAA
GGAGATCTCCAACTACACCCAGATCATCTACGGCCTGCTGGAGGAGTCCCAGAACCAGCAGGAGAAGAACGAGC
AGGACCTGCTGGCCCTGGACTAG
>HV1301295, CH505w30.12chim.6R.SOSIP.664v4.1 (SEQ ID NO. 217)
ATGCCCATGGGCTCCCTGCAGCCCCTGGCCACCCTGTACCTGCTGGGCATGCTGGTGGCCTCCGTGCTGGCCGC
CGAGAACCTGTGGGTGACCGTGTACTACGGCGTGCCCGTGTGGAAGGAGGCCAAGACCACCCTGTTCTGCGCCT
CCGACGCCAAGGCCTACGAGAAGAAGGTGCACAACGTGTGGGCCACCCACGCCTGCGTGCCCACCGACCCCAAC
CCCCAGGAGATGGTGCTGAAGAACGTGACCGAGAACTTCAACATGTGGAAGAACGACATGGTGGACCAGATGCA
CGAGGACGTGATCTCCCTGTGGGACCAGTCCCTGAAGCCCTGCGTGAAGCTGACCCCCCTGTGCGTGACCCTGA
ACTGCACCAACGCCACCAACGCCACCGCCTCCAACTCCTCCATCATCGAGGGCATGAAGAACTGCTCCTTCAAC
ATCACCACCGAGCTGCGCGACAAGCGCGAGAAGAAGAACGCCCTGTTCTACAAGCTGGACATCGTGCAGCTGGA
CGGCAACTCCTCCCAGTACCGCCTGATCAACTGCAACACCTCCGTGATCACCCAGGCCTGCCCCAAGGTGTCCT
TCGACCCCATCCCCATCCACTACTGCGCCCCCGCCGGCTACGCCATCCTGAAGTGCAACAACAAGACCTTCACC
GGCACCGGCCCCTGCAACAACGTGTCCACCGTGCAGTGCACCCACGGCATCAAGCCCGTGGTGTCCACCCAGCT
GCTGCTGAACGGCTCCCTGGCCGAGGGCGAGATCATCATCCGCTCCGAGAACATCACCAACAACGACAAGACCA
TCATCGTGCACCTGAACGAGTCCGTGAAGATCGAGTGCACCCGCCCCTCCAACAAGACCCGCACCTCCATCCGC
ATCGGCCCCGGCCAGTGGTTCTACGCCACCGGCCAGGTGATCGGCGACATCCGCGAGGCCTACTGCAACATCTC
CGAGTCCAAGTGGAACGAGACCCTGCAGCGCGTGTCCAAGAAGCTGAAGGAGTACTTCCCCCACAAGAACATCA
CCTTCCAGCCCTCCTCCGGCGGCGACCTGGAGATCACCACCCACTCCTTCAACTGCGGCGGCGAGTTCTTCTAC
TGCAACACCTCCTCCCTGTTCAACCGCACCTACATGGCCAACTCCACCGACATGGCCAACTCCACCGAGACCAA
CTCCACCCGCAACATCACCATCCACTGCCGCATCAAGCAGATCATCAACATGTGGCAGGAGGTGGGCCGCGCCA
TGTACGCCCCCCCCATCGCCGGCAACATCACCTGCATCTCCAACATCACCGGCCTGCTGCTGACCCGCGACGGC
GGCAAGAACGACACCGAGACCTTCCGCCCCGGCGGCGGCAACATGAAGGACAACTGGCGCTCCGAGCTGTACAA
GTACAAGGTGGTGAAGATCGAGCCCCTGGGCGTGGCCCCCACCCGCTGCAAGCGCCGCGTGGTGGGCCGCCGCC
GCCGCCGCCGCGCCGTGGGCATCGGCGCCGTGTTCCTGGGCTTCCTGGGCGCCGCCGGCTCCACCATGGGCGCC
GCCTCCATGACCCTGACCGTGCAGGCCCGCAACCTGCTGTCCGGCATCGTGCAGCAGCAGTCCAACCTGCTGCG
CGCCCCCGAGGCCCAGCAGCACCTGCTGAAGCTGACCGTGTGGGGCATCAAGCAGCTGCAGGCCCGCGTGCTGG
CC

Figure 22B cont.

GTGGAGCGCTACCTGCGCGACCAGCAGCTGCTGGGCATCTGGGGCTGCTCCGGCAAGCTGATCTGCTGCACCAA
CGTGCCCTGGAACTCCTCCTGGTCCAACCGCAACCTGTCCGAGATCTGGGACAACATGACCTGGCTGCAGTGGG
ACAAGGAGATCTCCAACTACACCCAGATCATCTACGGCCTGCTGGAGGAGTCCCAGAACCAGCAGGAGAAGAAC
GAGCAGGACCTGCTGGCCCTGGACTAG
>HV1301304, CH505w30.12chim.6R.SOSIP.664v4.2 (SEQ ID NO. 218)
ATGCCCATGGGCTCCCTGCAGCCCCTGGCCACCCTGTACCTGCTGGGCATGCTGGTGGCCTCCGTGCTGGCCGC
CGAGAACCTGTGGGTGACCGTGTACTACGGCGTGCCCGTGTGGAAGGAGGCCAAGACCACCCTGTTCTGCGCCT
CCGACGCCAAGGCCTACGAGAAGGAGGTGCGCAACGTGTGGGCCACCCACGCCTGCGTGCCCACCGACCCCAAC
CCCCAGGAGATGGTGCTGAAGAACGTGACCGAGAACTTCAACATGTGGAAGAACGACATGGTGGACCAGATGCA
CGAGGACGTGATCTCCCTGTGGGACCAGTCCCTGAAGCCCTGCGTGAAGCTGACCCCCCTGTGCGTGACCCTGA
ACTGCACCAACGCCACCAACGCCACCGCCTCCAACTCCTCCATCATCGAGGGCATGAAGAACTGCTCCTTCAAC
ATCACCACCGAGCTGCGCGACAAGCGCGAGAAGAAGAACGCCCTGTTCTACAAGCTGGACATCGTGCAGCTGGA
CGGCAACTCCTCCCAGTACCGCCTGATCAACTGCAACACCTCCGTGATCACCCAGGCCTGCCCCAAGGTGTCCT
TCGACCCCATCCCCATCCACTACTGCGCCCCCGCCGGCTACGCCATCCTGAAGTGCAACAACAAGACCTTCACC
GGCACCGGCCCCTGCAACAACGTGTCCACCGTGCAGTGCACCCACGGCATCAAGCCCGTGGTGTCCACCCAGCT
GCTGCTGAACGGCTCCCTGGCCGAGGGCGAGATCATCATCCGCTCCGAGAACATCACCAACAACGACAAGACCA
TCATCGTGCACCTGAACGAGTCCGTGAAGATCGAGTGCACCCGCCCCTCCAACAAGACCCGCACCTCCATCCGC
ATCGGCCCCGGCCAGTGGTTCTACGCCACCGGCCAGGTGATCGGCGACATCCGCGAGGCCTACTGCAACATCTC
CGAGTCCAAGTGGAACGAGACCCTGCAGCGCGTGTCCAAGAAGCTGAAGGAGTACTTCCCCCACAAGAACATCA
CCTTCCAGCCCTCCTCCGGCGGCGACCTGGAGATCACCACCCACTCCTTCAACTGCGGCGGCGAGTTCTTCTAC
TGCAACACCTCCTCCCTGTTCAACCGCACCTACATGGCCAACTCCACCGACATGGCCAACTCCACCGAGACCAA
CTCCACCCGCAACATCACCATCCACTGCCGCATCAAGCAGATCATCAACATGTGGCAGGAGGTGGGCCGCGCCA
TGTACGCCCCCCCCATCGCCGGCAACATCACCTGCATCTCCAACATCACCGGCCTGCTGCTGACCCGCGACGGC
GGCAAGAACGACACCGAGACCTTCCGCCCCGGCGGCGGCAACATGAAGGACAACTGGCGCTCCGAGCTGTACAA
GTACAAGGTGGTGAAGATCGAGCCCCTGGGCGTGGCCCCCACCCGCTGCAAGCGCCGCGTGGTGGGCCGCCGCC
GCCGCCGCCGCGCCGTGGGCATCGGCGCCGTGTTCCTGGGCTTCCTGGGCGCCGCCGGCTCCACCATGGGCGCC
GCCTCCATGACCCTGACCGTGCAGGCCCGCAACCTGCTGTCCGGCATCGTGCAGCAGCAGTCCAACCTGCTGCG
CGCCCCCGAGGCCCAGCAGCACCTGCTGAAGCTGACCGTGTGGGGCATCAAGCAGCTGCAGGCCCGCGTGCTGG
CCGTGGAGCGCTACCTGCGCGACCAGCAGCTGCTGGGCATCTGGGGCTGCTCCGGCAAGCTGATCTGCTGCACC
AACGTGCCCTGGAACTCCTCCTGGTCCAACCGCAACCTGTCCGAGATCTGGGACAACATGACCTGGCTGCAGTG
GGACAAGGAGATCTCCAACTACACCCAGATCATCTACGGCCTGCTGGAGGAGTCCCAGAACCAGCAGGAGAAGA
ACGAGCAGGACCTGCTGGCCCTGGACTAG
>HV1301296, CH505w30.20.chim.6R.SOSIP.664v4.1 (SEQ ID NO. 219)
ATGCCCATGGGCTCCCTGCAGCCCCTGGCCACCCTGTACCTGCTGGGCATGCTGGTGGCCTCCGTGCTGGCCGC
CGAGAACCTGTGGGTGACCGTGTACTACGGCGTGCCCGTGTGGAAGGAGGCCAAGACCACCCTGTTCTGCGCCT
CCGACGCCAAGGCCTACGAGAAGAAGGTGCACAACGTGTGGGCCACCCACGCCTGCGTGCCCACCGACCCCAAC
CCCCAGGAGATGGTGCTGAAGAACGTGACCGAGAACTTCAACATGTGGAAGAACGACATGGTGGACCAGATGCA
CGAGGACGTGATCTCCCTGTGGGACCAGTCCCTGAAGCCCTGCGTGAAGCTGACCCCCCTGTGCGTGACCCTGA
ACTGCACCAACGCCACCACCAACGCCACCGCCTCCAACTCCTCCATCATCGAGGGCATGAAGAACTGCTCCTTC
AACATCACCACCGAGCTGCGCGACAAGCGCGAGAAGAAGAACGCCCTGTTCTACAAGCTGGACATCGTGCAGCT
GGACGGCAACTCCTCCCAGTACCGCCTGATCAACTGCAACACCTCCGTGATCACCCAGGCCTGCCCCAAGGTGT
CCTTCGACCCCATCCCCATCCACTACTGCGCCCCCGCCGGCTACGCCATCCTGAAGTGCAACAACAAGACCTTC
ACCGGCACCGGCCCCTGCAACAACGTGTCCACCGTGCAGTGCACCCACGGCATCAAGCCCGTGGTGTCCACCCA
GCTGCTGCTGAACGGCTCCCTGGCCGAGGGCGAGATCATCATCCGCTCCGAGAACATCACCAACAACGCCAAGA
CCATCATCGTGCACCTGAACGAGTCCGTGAAGATCGAGTGCACCCGCCCCAACAACAAGACCCGCACCTCCATC
CGCATCGGCCCCGGCCAGTGGTTCTACGCCACCGGCCAGGTGATCGGCGACATCCGCGAGGCCTACTGCAACAT
CTCCGAGTCCAAGTGGAACGAGACCCTGCAGCGCGTGTCCAAGAAGCTGAAGGAGTACTTCCCCCACAAGAACA
TCACCTTCCAGCCCTCCTCCGGCGGCGACCTGGAGATCACCACCCACTCCTTCAACTGCGGCGGCGAGTTCTTC
TACTGCAACACCTCCTCCCTGTTCAACCGCACCTACATGGCCAACTCCACCGACATGGCCAACTCCACCGAGAC
CAACTCCACCCGCATCATCACCATCCACTGCCGCATCAAGCAGATCATCAACATGTGGCAGGAGGTGGGCCGCG
CCATGTACGCCCCCCCCATCGCCGGCAACATCACCTGCATCTCCAACATCACCGGCCTGCTGCTGACCCGCGAC
GGCGGCAAGAACACCCGCGACGGCGGCAAGAACAACACCGAGACCTTCCGCCCCGGCGGCGGCAACATGAAGGA
CAACTGGCGCTCCG

Figure 22B cont.

AGCTGTACAAGTACAAGGTGGTGAAGATCGAGCCCCTGGGCGTGGCCCCCACCCGCTGCAAGCGCCGCGTGGTG
GGCCGCCGCCGCCGCCGCCGCGCCGTGGGCATCGGCGCCGTGTTCCTGGGCTTCCTGGGCGCCGCCGGCTCCAC
CATGGGCGCCGCCTCCATGACCCTGACCGTGCAGGCCCGCAACCTGCTGTCCGGCATCGTGCAGCAGCAGTCCA
ACCTGCTGCGCGCCCCCGAGGCCCAGCAGCACCTGCTGAAGCTGACCGTGTGGGGCATCAAGCAGCTGCAGGCC
CGCGTGCTGGCCGTGGAGCGCTACCTGCGCGACCAGCAGCTGCTGGGCATCTGGGGCTGCTCCGGCAAGCTGAT
CTGCTGCACCAACGTGCCCTGGAACTCCTCCTGGTCCAACCGCAACCTGTCCGAGATCTGGGACAACATGACCT
GGCTGCAGTGGGACAAGGAGATCTCCAACTACACCCAGATCATCTACGGCCTGCTGGAGGAGTCCCAGAACCAG
CAGGAGAAGAACGAGCAGGACCTGCTGGCCCTGGACTAG

>HV1301305, CH505w30.20chim.6R.SOSIP.664v4.2 (SEQ ID NO. 220)
ATGCCCATGGGCTCCCTGCAGCCCCTGGCCACCCTGTACCTGCTGGGCATGCTGGTGGCCTCCGTGCTGGCCGC
CGAGAACCTGTGGGTGACCGTGTACTACGGCGTGCCCGTGTGGAAGGAGGCCAAGACCACCCTGTTCTGCGCCT
CCGACGCCAAGGCCTACGAGAAGGAGGTGCGCAACGTGTGGGCCACCCACGCCTGCGTGCCCACCGACCCCAAC
CCCCAGGAGATGGTGCTGAAGAACGTGACCGAGAACTTCAACATGTGGAAGAACGACATGGTGGACCAGATGCA
CGAGGACGTGATCTCCCTGTGGGACCAGTCCCTGAAGCCCTGCGTGAAGCTGACCCCCCTGTGCGTGACCCTGA
ACTGCACCAACGCCACCACCAACGCCACCGCCTCCAACTCCTCCATCATCGAGGGCATGAAGAACTGCTCCTTC
AACATCACCACCGAGCTGCGCGACAAGCGCGAGAAGAAGAACGCCCTGTTCTACAAGCTGGACATCGTGCAGCT
GGACGGCAACTCCTCCCAGTACCGCCTGATCAACTGCAACACCTCCGTGATCACCCAGGCCTGCCCCAAGGTGT
CCTTCGACCCCATCCCCATCCACTACTGCGCCCCCGCCGGCTACGCCATCCTGAAGTGCAACAACAAGACCTTC
ACCGGCACCGGCCCCTGCAACAACGTGTCCACCGTGCAGTGCACCCACGGCATCAAGCCCGTGGTGTCCACCCA
GCTGCTGCTGAACGGCTCCCTGGCCGAGGGCGAGATCATCATCCGCTCCGAGAACATCACCAACAACGCCAAGA
CCATCATCGTGCACCTGAACGAGTCCGTGAAGATCGAGTGCACCCGCCCCAACAACAAGACCCGCACCTCCATC
CGCATCGGCCCCGGCCAGTGGTTCTACGCCACCGGCCAGGTGATCGGCGACATCCGCGAGGCCTACTGCAACAT
CTCCGAGTCCAAGTGGAACGAGACCCTGCAGCGCGTGTCCAAGAAGCTGAAGGAGTACTTCCCCCACAAGAACA
TCACCTTCCAGCCCTCCTCCGGCGGCGACCTGGAGATCACCACCCACTCCTTCAACTGCGGCGGCGAGTTCTTC
TACTGCAACACCTCCTCCCTGTTCAACCGCACCTACATGGCCAACTCCACCGACATGGCCAACTCCACCGAGAC
CAACTCCACCCGCATCATCACCATCCACTGCCGCATCAAGCAGATCATCAACATGTGGCAGGAGGTGGGCCGCG
CCATGTACGCCCCCCCCATCGCCGGCAACATCACCTGCATCTCCAACATCACCGGCCTGCTGCTGACCCGCGAC
GGCGGCAAGAACACCCGCGACGGCGGCAAGAACAACACCGAGACCTTCCGCCCCGGCGGCGGCAACATGAAGGA
CAACTGGCGCTCCGAGCTGTACAAGTACAAGGTGGTGAAGATCGAGCCCCTGGGCGTGGCCCCCACCCGCTGCA
AGCGCCGCGTGGTGGGCCGCCGCCGCCGCCGCCGCGCCGTGGGCATCGGCGCCGTGTTCCTGGGCTTCCTGGGC
GCCGCCGGCTCCACCATGGGCGCCGCCTCCATGACCCTGACCGTGCAGGCCCGCAACCTGCTGTCCGGCATCGT
GCAGCAGCAGTCCAACCTGCTGCGCGCCCCCGAGGCCCAGCAGCACCTGCTGAAGCTGACCGTGTGGGGCATCA
AGCAGCTGCAGGCCCGCGTGCTGGCCGTGGAGCGCTACCTGCGCGACCAGCAGCTGCTGGGCATCTGGGGCTGC
TCCGGCAAGCTGATCTGCTGCACCAACGTGCCCTGGAACTCCTCCTGGTCCAACCGCAACCTGTCCGAGATCTG
GGACAACATGACCTGGCTGCAGTGGGACAAGGAGATCTCCAACTACACCCAGATCATCTACGGCCTGCTGGAGG
AGTCCCAGAACCAGCAGGAGAAGAACGAGCAGGACCTGCTGGCCCTGGACTAG >HV1301189, CH505TFchim.6R.SOSIP.664v4.1 (SEQ ID NO. 221)
ATGCCCATGGGCAGCCTGCAGCCCCTGGCCACCCTGTACCTGCTGGGCATGCTGGTGGCTAGCGTGCTGGCCGCCGAGAA
CCTGTGGGTGACCGTCTACTATGGCGTGCCCGTCTGGAAGGAAGCCAAAACCACACTGTTCTGCGCTAGCGACGCTAAGG
CATACGAGAAAAAAGTGCACAATGTCTGGGCTACTCATGCATGCGTGCCTACCGATCCAAATCCCCAGGAGATGGTGCTG
AAGAACGTCACAGAAAACTTTAATATGTGGAAGAACGACATGGTGGATCAGATGCACGAGGACGTGATCAGCCTGTGGGA
TCAGTCCCTGAAGCCATGCGTGAAACTGACTCCCCTGTGCGTCACCCTGAACTGTACTAATGCCACCGCTTCCAACAGCT
CCATCATTGAGGGGATGAAGAACTGTTCTTTCAATATCACTACCGAGCTGCGCGACAAGCGAGAAAAGAAAAATGCCCTG
TTTTACAAACTGGACATCGTGCAGCTGGATGGCAACTCTAGTCAGTATAGACTGATTAACTGCAATACAAGCGTGATCAC
TCAGGCATGTCCAAAGGTCAGTTTCGATCCTATTCCAATCCACTACTGCGCACCCGCCGGATATGCTATCCTGAAGTGTA
ACAACAAGACCTTCACCGGCACTGGGCCTTGCAACAACGTGAGCACCGTCCAGTGTACACATGGCATTAAGCCAGTGGTC
AGCACCCAGCTGCTGCTGAACGGCAGCCTGGCAGAGGGCGAAATCATTATCCGCAGCGAGAACATCACAAATAATGTGAA
GACTATCATCGTCCACCTGAACGAGAGCGTGAAGATTGAATGCACACGGCCCAACAACAAGACCAGGACATCCATTCGCA
TCGGACCTGGCCAGTGGTTCTACGCTACTGGCCAGGTCATCGGGGACATCAGAGAGGCCTATTGTAACATCAATGAGTCA
AAGTGGAATGAAACTCTGCAGAGGGTGAGCAAGAAACTGAAGGAATACTTCCCTCACAAAAACATCACCTTTCAGCCATC
AAGCGGCGGGGACCTGGAGATTACAACTCATTCTTTCAATTGCGGAGGCGAATTCTTTTACTGTAACACCTCCTCTCTGT
TTAATCGCACATATATGGCTAACAGTACTGATATG

Figure 22B cont.

GCAAACTCTACTGAGACCAATAGTACACGAACTATTACCATCCATTGCCGGATCAAGCAGATTATCAACATGTGGCAGGA
AGTGGGGCGGGCCATGTATGCTCCCCCTATTGCAGGAAATATTACCTGTATCAGCAACATTACCGGCCTGCTGCTGACAA
GAGACGGGGGAAAGAACAATACAGAGACTTTTAGGCCTGGCGGGGGAAACATGAAAGATAATTGGCGCTCCGAGCTGTAC
AAGTATAAAGTGGTCAAGATCGAACCACTGGGAGTGGCACCTACCCGATGTAAACGGAGAGTGGTCGGAAGGCGCCGACG
GAGAAGGGCAGTGGGAATCGGAGCCGTCTTCCTGGGCTTTCTGGGAGCAGCTGGCAGCACAATGGGAGCAGCCTCTATGA
CCCTGACAGTGCAGGCTCGAAATCTGCTGAGTGGGATCGTGCAGCAGCAGTCAAACCTGCTGCGAGCACCAGAGGCACAG
CAGCATCTGCTGAAGCTGACCGTGTGGGGCATCAAGCAGCTGCAGGCCAGAGTGCTGGCTGTCGAACGGTACCTGAGAGA
TCAGCAGCTGCTGGGAATCTGGGGATGCAGCGGAAAGCTGATTTGCTGTACAAACGTGCCCTGGAATAGTTCATGGTCAA
ACAGGAATCTGAGCGAGATCTGGGACAATATGACCTGGCTGCAGTGGGATAAGGAAATCAGTAACTACACACAGATCATC
TATGGCCTGCTGGAGGAATCACAGAACCAGCAGGAGAAAAATGAACAGGACCTGCTGGCCCTGGATTGA

>HV1301190, CH505TFchim.6R.SOSIP.664v4.2 (SEQ ID NO. 222)
ATGGGCAGCCTGCAGCCCCTGGCCACCCTGTACCTGCTGGGCATGCTGGTGGCTAGCGTGCTGGCCGCCGAGAA
CCTGTGGGTGACCGTCTACTATGGCGTGCCCGTCTGGAAGGAAGCCAAAACCACACTGTTCTGCGCTAGCGACG
CTAAGGCATACGAGAAAGAAGTGAGAAATGTCTGGGCTACTCATGCATGCGTGCCTACCGATCCAAATCCCCAG
GAGATGGTGCTGAAGAACGTCACAGAAAACTTTAATATGTGGAAGAACGACATGGTGGATCAGATGCACGAGGA
CGTGATCAGCCTGTGGGATCAGTCCCTGAAGCCATGCGTGAAACTGACTCCCCTGTGCGTCACCCTGAACTGTA
CTAATGCCACCGCTTCCAACAGCTCCATCATTGAGGGGATGAAGAACTGTTCTTTCAATATCACTACCGAGCTG
CGCGACAAGCGAGAAAAGAAAAATGCCCTGTTTTACAAACTGGACATCGTGCAGCTGGATGGCAACTCTAGTCA
GTATAGACTGATTAACTGCAATACAAGCGTGATCACTCAGGCATGTCCAAAGGTCAGTTTCGATCCTATTCCAA
TCCACTACTGCGCACCCGCCGGATATGCTATCCTGAAGTGTAACAACAAGACCTTCACCGGCACTGGGCCTTGC
AACAACGTGAGCACCGTCCAGTGTACACATGGCATTAAGCCAGTGGTCAGCACCCAGCTGCTGCTGAACGGCAG
CCTGGCAGAGGGCGAAATCATTATCCGCAGCGAGAACATCACAAATAATGTGAAGACTATCATCGTCCACCTGA
ACGAGAGCGTGAAGATTGAATGCACACGGCCCAACAACAAGACCAGGACATCCATTCGCATCGGACCTGGCCAG
TGGTTCTACGCTACTGGCCAGGTCATCGGGGACATCAGAGAGGCCTATTGTAACATCAATGAGTCAAAGTGGAA
TGAAACTCTGCAGAGGGTGAGCAAGAAACTGAAGGAATACTTCCCTCACAAAAACATCACCTTTCAGCCATCAA
GCGGCGGGGACCTGGAGATTACAACTCATTCTTTCAATTGCGGAGGCGAATTCTTTTACTGTAACACCTCCTCT
CTGTTTAATCGCACATATATGGCTAACAGTACTGATATGGCAAACTCTACTGAGACCAATAGTACACGAACTAT
TACCATCCATTGCCGGATCAAGCAGATTATCAACATGTGGCAGGAAGTGGGGCGGGCCATGTATGCTCCCCCTA
TTGCAGGAAATATTACCTGTATCAGCAACATTACCGGCCTGCTGCTGACAAGAGACGGGGGAAAGAACAATACA
GAGACTTTTAGGCCTGGCGGGGGAAACATGAAAGATAATTGGCGCTCCGAGCTGTACAAGTATAAAGTGGTCAA
GATCGAACCACTGGGAGTGGCACCTACCCGATGTAAACGGAGAGTGGTCGGAAGGCGCCGACGGAGAAGGGCAG
TGGGAATCGGAGCCGTCTTCCTGGGCTTTCTGGGAGCAGCTGGCAGCACAATGGGAGCAGCCTCTATGACCCTG
ACAGTGCAGGCTCGAAATCTGCTGAGTGGGATCGTGCAGCAGCAGTCAAACCTGCTGCGAGCACCAGAGGCACA
GCAGCATCTGCTGAAGCTGACCGTGTGGGGCATCAAGCAGCTGCAGGCCAGAGTGCTGGCTGTCGAACGGTACC
TGAGAGATCAGCAGCTGCTGGGAATCTGGGGATGCAGCGGAAAGCTGATTTGCTGTACAAACGTGCCCTGGAAT
AGTTCATGGTCAAACAGGAATCTGAGCGAGATCTGGGACAATATGACCTGGCTGCAGTGGGATAAGGAAATCAG
TAACTACACACAGATCATCTATGGCCTGCTGGAGGAATCACAGAACCAGCAGGAGAAAAATGAACAGGACCTGC
TGGCCCTGGATTGA >CH505w030.25chim.6R.SOSIP.664 (SEQ ID NO. 223)

ATGGGCTCCCTGCAGCCCCTGGCCACCCTGTACCTGCTGGGCATGCTGGTGGCCTCCGTGCTGGCCGCCGAGAACCT
GTGGGTGACCGTGTACTACGGCGTGCCCGTGTGGAAGGAGGCCAAGACCACCCTGTTCTGCGCCTCCGACGCCAAG
GCCTACGAGAAGGAGGTGCACAACGTGTGGGCCACCCACGCCTGCGTGCCCACCGACCCCAACCCCCAGGAGATGG
TGCTGAAGAACGTGACCGAGAACTTCAACATGTGGAAGAACGACATGGTGGACCAGATGCACGAGGACGTGATCTC
CCTGTGGGACCAGTCCCTGAAGCCCTGCGTGAAGCTGACCCCCCTGTGCGTGACCCTGAACTGCACCAACGCCACCAC
CAACGCCACCGCCTCCAACTCCTCCATCATCGAGGGCATGAAGAACTGCTCCTTCAACATCACCACCG

Figure 22B cont.

AGCTGCGCGACAAGCGCGAGAAGAAGAACGCCCTGTTCTACAAGCTGGACATCGTGCAGCTGGACGGCAACTCCTCC
CAGTACCGCCTGATCAACTGCAACACCTCCGTGATCACCCAGGCCTGCCCCAAGGTGTCCTTCGACCCCATCCCCATCC
ACTACTGCGCCCCCGCCGGCTACGCCATCCTGAAGTGCAACAACAAGACCTTCACCGGCACCGGCCCCTGCAACAACG
TGTCCACCGTGCAGTGCACCCACGGCATCAAGCCCGTGGTGTCCACCCAGCTGCTGCTGAACGGCTCCCTGGCCGAG
GGCGAGATCATCATCCGCTCCGAGAACATCACCAACAACGCCAAGACCATCATCGTGCACCTGAACGAGTCCGTGAA
GATCGAGTGCACCCGCCCCAACAACAAGACCCGCACCTCCATCCGCATCGGCCCCGGCCAGGCCTTCTACGCCACCGG
CCAGGTGATCGGCGACATCCGCGAGGCCCACTGCAACATCTCCGAGTCCAAGTGGAACGAGACCCTGCAGCGCGTGT
CCAAGAAGCTGAAGGAGTACTTCCCCCACAAGAACATCACCTTCCAGCCCTCCTCCGGCGGCGACCTGGAGATCACCA
CCCACTCCTTCAACTGCGGCGGCGAGTTCTTCTACTGCAACACCTCCTCCCTGTTCAACCGCACCTACATGGCCAACTC
CACCGACATGGCCAACTCCACCGAGACCAACTCCACCCGCACCATCACCATCCGCTGCCGCATCAAGCAGATCATCAA
CATGTGGCAGGAGGTGGGCCGCGCCATGTACGCCCCCCCCATCGCCGGCAACATCACCTGCATCTCCAACATCACCG
GCCTGCTGCTGACCCGCGACGGCGGCAAGAACAACACCGACACCGAGACCTTCCGCCCCGGCGGCGGCAACATGAA
GGACAACTGGCGCTCCGAGCTGTACAAGTACAAGGTGGTGAAGATCGAGCCCCTGGGCGTGGCCCCCACCCGCTGC
AAGCGCCGCGTGGTGGGCCGCCGCCGCCGCCGCCGCGCCGTGGGCATCGGCGCCGTGTTCCTGGGCTTCCTGGGCG
CCGCCGGCTCCACCATGGGCGCCGCCTCCATGACCCTGACCGTGCAGGCCCGCAACCTGCTGTCCGGCATCGTGCAG
CAGCAGTCCAACCTGCTGCGCGCCCCCGAGGCCCAGCAGCACCTGCTGAAGCTGACCGTGTGGGGCATCAAGCAGCT
GCAGGCCCGCGTGCTGGCCGTGGAGCGCTACCTGCGCGACCAGCAGCTGCTGGGCATCTGGGGCTGCTCCGGCAAG
CTGATCTGCTGCACCAACGTGCCCTGGAACTCCTCCTGGTCCAACCGCAACCTGTCCGAGATCTGGGACAACATGACC
TGGCTGCAGTGGGACAAGGAGATCTCCAACTACACCCAGATCATCTACGGCCTGCTGGAGGAGTCCCAGAACCAGCA
GGAGAAGAACGAGCAGGACCTGCTGGCCCTGGACtag >CH505w030.25chim.DS.6R.SOSIP.664 (SEQ ID NO. 224)

ATGGGCTCCCTGCAGCCCCTGGCCACCCTGTACCTGCTGGGCATGCTGGTGGCCTCCGTGCTGGCCGCCGAGAACCT
GTGGGTGACCGTGTACTACGGCGTGCCCGTGTGGAAGGAGGCCAAGACCACCCTGTTCTGCGCCTCCGACGCCAAG
GCCTACGAGAAGGAGGTGCACAACGTGTGGGCCACCCACGCCTGCGTGCCCACCGACCCCAACCCCCAGGAGATGG
TGCTGAAGAACGTGACCGAGAACTTCAACATGTGGAAGAACGACATGGTGGACCAGATGCACGAGGACGTGATCTC
CCTGTGGGACCAGTCCCTGAAGCCCTGCGTGAAGCTGACCCCCCTGTGCGTGACCCTGAACTGCACCAACGCCACCAC
CAACGCCACCGCCTCCAACTCCTCCATCATCGAGGGCATGAAGAACTGCTCCTTCAACATCACCACCGAGCTGCGCGA
CAAGCGCGAGAAGAAGAACGCCCTGTTCTACAAGCTGGACATCGTGCAGCTGGACGGCAACTCCTCCCAGTACCGCC
TGATCAACTGCAACACCTCCGTGTGCACCCAGGCCTGCCCCAAGGTGTCCTTCGACCCCATCCCCATCCACTACTGCGC
CCCCGCCGGCTACGCCATCCTGAAGTGCAACAACAAGACCTTCACCGGCACCGGCCCCTGCAACAACGTGTCCACCGT
GCAGTGCACCCACGGCATCAAGCCCGTGGTGTCCACCCAGCTGCTGCTGAACGGCTCCCTGGCCGAGGGCGAGATCA
TCATCCGCTCCGAGAACATCACCAACAACGCCAAGACCATCATCGTGCACCTGAACGAGTCCGTGAAGATCGAGTGC
ACCCGCCCCAACAACAAGACCCGCACCTCCATCCGCATCGGCCCCGGCCAGGCCTTCTACGCCACCGGCCAGGTGATC
GGCGACATCCGCGAGGCCCACTGCAACATCTCCGAGTCCAAGTGGAACGAGACCCTGCAGCGCGTGTCCAAGAAGCT
GAAGGAGTACTTCCCCCACAAGAACATCACCTTCCAGCCCTCCTCCGGCGGCGACCTGGAGATCACCACCCACTCCTT
CAACTGCGGCGGCGAGTTCTTCTACTGCAACACCTCCTCCCTGTTCAACCGCACCTACATGGCCAACTCCACCGACATG
GCCAACTCCACCGAGACCAACTCCACCCGCACCATCACCATCCGCTGCCGCATCAAGCAGATCATCAACATGTGGCAG
GAGGTGGGCCGCTGCATGTACGCCCCCCCCATCGCCGGCAACATCACCTGCATCTCCAACATCACCGGCCTGCTGCTG
ACCCGCGACGGCGGCAAGAACAACACCGACACCGAGACCTTCCGCCCCGGCGGCGGCAACATGAAGGACAACTGGC
GCTCCGAGCTGTACAAGTACAAGGTGGTGAAGATCGAGCCCCTGGGCGTGGCCCCCACCCGCTGCAAGCGCCGCGT
GGTGGGCCGCCGCCGCCGCCGCCGCGCCGTGGGCATCGGCGCCGTGTTCCTGGGCTTCCTGGGCGCCGCCGGCTCC
ACCATGGGCGCCGCCTCCATGACCCTGACCGTGCAGGCCCGCAACCTGCTGTCCGGCATCGTGCAGCAGCAGTCCAA
CCTGCTGCGCGCCCCCGAGGCCCAGCAGCACCTGCTGAAGCTGACCGTGTGGGGCATCAAGCAGCTGCAGGCCCGC
GTGCTGGCCGTGGAGCGCTACCTGCGCGACCAGCAGCTGCTGGGCATCTGGGGCTGCTCCGGCAAGCTGATCTGCTG

Figure 22B cont.

CACCAACGTGCCCTGGAACTCCTCCTGGTCCAACCGCAACCTGTCCGAGATCTGGGACAACATGACCTGGCTGCAGTG
GGACAAGGAGATCTCCAACTACACCCAGATCATCTACGGCCTGCTGGAGGAGTCCCAGAACCAGCAGGAGAAGAAC
GAGCAGGACCTGCTGGCCCTGGACtag >CH505w030.25chim.6R.SOSIP.664v4.1 (SEQ ID NO. 225)

ATGGGCTCCCTGCAGCCCCTGGCCACCCTGTACCTGCTGGGCATGCTGGTGGCCTCCGTGCTGGCCGCCGAGAACCT
GTGGGTGACCGTGTACTACGGCGTGCCCGTGTGGAAGGAGGCCAAGACCACCCTGTTCTGCGCCTCCGACGCCAAG
GCCTACGAGAAGAAGGTGCACAACGTGTGGGCCACCCACGCCTGCGTGCCCACCGACCCCAACCCCCAGGAGATGG
TGCTGAAGAACGTGACCGAGAACTTCAACATGTGGAAGAACGACATGGTGGACCAGATGCACGAGGACGTGATCTC
CCTGTGGGACCAGTCCCTGAAGCCCTGCGTGAAGCTGACCCCCCTGTGCGTGACCCTGAACTGCACCAACGCCACCAC
CAACGCCACCGCCTCCAACTCCTCCATCATCGAGGGCATGAAGAACTGCTCCTTCAACATCACCACCGAGCTGCGCGA
CAAGCGCGAGAAGAAGAACGCCCTGTTCTACAAGCTGGACATCGTGCAGCTGGACGGCAACTCCTCCCAGTACCGCC
TGATCAACTGCAACACCTCCGTGATCACCCAGGCCTGCCCCAAGGTGTCCTTCGACCCCATCCCCATCCACTACTGCGC
CCCCGCCGGCTACGCCATCCTGAAGTGCAACAACAAGACCTTCACCGGCACCGGCCCCTGCAACAACGTGTCCACCGT
GCAGTGCACCCACGGCATCAAGCCCGTGGTGTCCACCCAGCTGCTGCTGAACGGCTCCCTGGCCGAGGGCGAGATCA
TCATCCGCTCCGAGAACATCACCAACAACGCCAAGACCATCATCGTGCACCTGAACGAGTCCGTGAAGATCGAGTGC
ACCCGCCCCAACAACAAGACCCGCACCTCCATCCGCATCGGCCCCGGCCAGTGGTTCTACGCCACCGGCCAGGTGATC
GGCGACATCCGCGAGGCCCACTGCAACATCTCCGAGTCCAAGTGGAACGAGACCCTGCAGCGCGTGTCCAAGAAGCT
GAAGGAGTACTTCCCCCACAAGAACATCACCTTCCAGCCCTCCTCCGGCGGCGACCTGGAGATCACCACCCACTCCTT
CAACTGCGGCGGCGAGTTCTTCTACTGCAACACCTCCTCCCTGTTCAACCGCACCTACATGGCCAACTCCACCGACATG
GCCAACTCCACCGAGACCAACTCCACCCGCACCATCACCATCCGCTGCCGCATCAAGCAGATCATCAACATGTGGCAG
GAGGTGGGCCGCGCCATGTACGCCCCCCCCATCGCCGGCAACATCACCTGCATCTCCAACATCACCGGCCTGCTGCTG
ACCCGCGACGGCGGCAAGAACAACACCGACACCGAGACCTTCCGCCCCGGCGGCGGCAACATGAAGGACAACTGGC
GCTCCGAGCTGTACAAGTACAAGGTGGTGAAGATCGAGCCCCTGGGCGTGGCCCCCACCCGCTGCAAGCGCCGCGT
GGTGGGCCGCCGCCGCCGCCGCCGCGCCGTGGGCATCGGCGCCGTGTTCCTGGGCTTCCTGGGCGCCGCCGGCTCC
ACCATGGGCGCCGCCTCCATGACCCTGACCGTGCAGGCCCGCAACCTGCTGTCCGGCATCGTGCAGCAGCAGTCCAA
CCTGCTGCGCGCCCCCGAGGCCCAGCAGCACCTGCTGAAGCTGACCGTGTGGGGCATCAAGCAGCTGCAGGCCCGC
GTGCTGGCCGTGGAGCGCTACCTGCGCGACCAGCAGCTGCTGGGCATCTGGGGCTGCTCCGGCAAGCTGATCTGCTG
CACCAACGTGCCCTGGAACTCCTCCTGGTCCAACCGCAACCTGTCCGAGATCTGGGACAACATGACCTGGCTGCAGTG
GGACAAGGAGATCTCCAACTACACCCAGATCATCTACGGCCTGCTGGAGGAGTCCCAGAACCAGCAGGAGAAGAAC
GAGCAGGACCTGCTGGCCCTGGACtag

Figure 22B cont.

>CH505w030.25chim.6R.SOSIP.664v4.2 (SEQ ID NO. 226)

ATGGGCTCCCTGCAGCCCCTGGCCACCCTGTACCTGCTGGGCATGCTGGTGGCCTCCGTGCTGGCCGCCGAGAACCT
GTGGGTGACCGTGTACTACGGCGTGCCCGTGTGGAAGGAGGCCAAGACCACCCTGTTCTGCGCCTCCGACGCCAAG
GCCTACGAGAAGGAGGTGCGCAACGTGTGGGCCACCCACGCCTGCGTGCCCACCGACCCCAACCCCCAGGAGATGG
TGCTGAAGAACGTGACCGAGAACTTCAACATGTGGAAGAACGACATGGTGGACCAGATGCACGAGGACGTGATCTC
CCTGTGGGACCAGTCCCTGAAGCCCTGCGTGAAGCTGACCCCCCTGTGCGTGACCCTGAACTGCACCAACGCCACCAC
CAACGCCACCGCCTCCAACTCCTCCATCATCGAGGGCATGAAGAACTGCTCCTTCAACATCACCACCGAGCTGCGCGA
CAAGCGCGAGAAGAAGAACGCCCTGTTCTACAAGCTGGACATCGTGCAGCTGGACGGCAACTCCTCCCAGTACCGCC
TGATCAACTGCAACACCTCCGTGATCACCCAGGCCTGCCCCAAGGTGTCCTTCGACCCCATCCCCATCCACTACTGCGC
CCCCGCCGGCTACGCCATCCTGAAGTGCAACAACAAGACCTTCACCGGCACCGGCCCCTGCAACAACGTGTCCACCGT
GCAGTGCACCCACGGCATCAAGCCCGTGGTGTCCACCCAGCTGCTGCTGAACGGCTCCCTGGCCGAGGGCGAGATCA
TCATCCGCTCCGAGAACATCACCAACAACGCCAAGACCATCATCGTGCACCTGAACGAGTCCGTGAAGATCGAGTGC
ACCCGCCCCAACAACAAGACCCGCACCTCCATCCGCATCGGCCCCGGCCAGTGGTTCTACGCCACCGGCCAGGTGATC
GGCGACATCCGCGAGGCCCACTGCAACATCTCCGAGTCCAAGTGGAACGAGACCCTGCAGCGCGTGTCCAAGAAGCT
GAAGGAGTACTTCCCCCACAAGAACATCACCTTCCAGCCCTCCTCCGGCGGCGACCTGGAGATCACCACCCACTCCTT
CAACTGCGGCGGCGAGTTCTTCTACTGCAACACCTCCTCCCTGTTCAACCGCACCTACATGGCCAACTCCACCGACATG
GCCAACTCCACCGAGACCAACTCCACCCGCACCATCACCATCCGCTGCCGCATCAAGCAGATCATCAACATGTGGCAG
GAGGTGGGCCGCGCCATGTACGCCCCCCCCATCGCCGGCAACATCACCTGCATCTCCAACATCACCGGCCTGCTGCTG
ACCCGCGACGGCGGCAAGAACAACACCGACACCGAGACCTTCCGCCCCGGCGGCGGCAACATGAAGGACAACTGGC
GCTCCGAGCTGTACAAGTACAAGGTGGTGAAGATCGAGCCCCTGGGCGTGGCCCCCACCCGCTGCAAGCGCCGCGT
GGTGGGCCGCCGCCGCCGCCGCCGCGCCGTGGGCATCGGCGCCGTGTTCCTGGGCTTCCTGGGCGCCGCCGGCTCC
ACCATGGGCGCCGCCTCCATGACCCTGACCGTGCAGGCCCGCAACCTGCTGTCCGGCATCGTGCAGCAGCAGTCCAA
CCTGCTGCGCGCCCCCGAGGCCCAGCAGCACCTGCTGAAGCTGACCGTGTGGGGCATCAAGCAGCTGCAGGCCCGC
GTGCTGGCCGTGGAGCGCTACCTGCGCGACCAGCAGCTGCTGGGCATCTGGGGCTGCTCCGGCAAGCTGATCTGCTG
CACCAACGTGCCCTGGAACTCCTCCTGGTCCAACCGCAACCTGTCCGAGATCTGGGACAACATGACCTGGCTGCAGTG
GGACAAGGAGATCTCCAACTACACCCAGATCATCTACGGCCTGCTGGAGGAGTCCCAGAACCAGCAGGAGAAGAAC
GAGCAGGACCTGCTGGCCCTGGACtag >CH505w053.25chim.6R.SOSIP.664 (SEQ ID NO. 227)

ATGGGCTCCCTGCAGCCCCTGGCCACCCTGTACCTGCTGGGCATGCTGGTGGCCTCCGTGCTGGCCGCCGAGAACCT
GTGGGTGACCGTGTACTACGGCGTGCCCGTGTGGAAGGAGGCCAAGACCACCCTGTTCTGCGCCTCCGACGCCAAG
GCCTACGAGAAGGAGGTGCACAACGTGTGGGCCACCCACGCCTGCGTGCCCACCGACCCCAACCCCCAGGAGATGG
TGCTGAAGAACGTGACCGAGAACTTCAACATGTGGGAGAACGACATGGTGGACCAGATGCACGAGGACGTGATCTC
CCTGTGGGACCAGTCCCTGAAGCCCTGCGTGAAGCTGACCCCCCTGTGCGTGACCCTGAACTGCACCGACGCCACCG
CCTCCAACGCCACCGCCTCCAACGCCACCGCCTCCAACTCCTCCATCATCGAGGGCATGAAGAACTGCTCCTTCAACAT
CACCACCGAGCTGCGCGACAAGCGCGAGAAGAAGAACGCCCTGTTCTACAAGCTGGACATCGTGCAGCTGGACGGC
AACTCCTCCCAGTACCGCCTGATCAACTGCAACACCTCCGTGATCACCCAGGCCTGCCCCAAGGTGTCCTTCGACCCCA
TCCCCATCCACTACTGCGCCCCCGCCGGCTACGCCATCCTGAAGTGCAACAACAAGACCTTC

Figure 22B cont.

AACGGCACCGGCCCCTGCAACAACGTGTCCACCGTGCAGTGCACCCACGGCATCAAGCCCGTGGTGTCCACCCAGCT
GCTGCTGAACGGCTCCCTGGCCGAGGGCGAGATCATCATCCGCTCCGAGAACATCACCGACAACGGCAAGACCATCA
TCGTGCACCTGAACGAGTCCGTGAAGATCGAGTGCACCCGCCCCTCCAACAACACCCGCACCTCCATCCGCATCGGCC
CCGGCCAGGCCTTCTACGCCACCGGCCAGGTGATCGGCGACATCCGCGAGGCCCACTGCAACATCTCCGAGAACAAG
TGGAACGAGACCCTGCAGCGCGTGTCCAAGAAGCTGAAGGAGTACTTCCCCCACAAGAACATCACCTTCCAGCCCTC
CTCCGGCGGCGACCTGGAGATCACCACCCACTCCTTCAACTGCGGCGGCGAGTTCTTCTACTGCAACACCTCCTCCCTG
TTCAACCGCACCTACATGGCCAACTCCACCGACATGGCCAACTCCACCGAGACCAACTCCACCCGCACCATCACCATCC
GCTGCCGCATCAAGCAGATCATCAACATGTGGCAGGAGGTGGGCCGCGCCATGTACGCCCCCCCCATCGCCGGCAAC
ATCACCTGCATCTCCAACATCACCGGCCTGCTGCTGACCCGCGACGGCGGCAAGAACAACACCGAGACCTTCGAGAC
CTTCCGCCCCGGCGGCGGCAACATGAAGGACAACTGGCGCTCCGAGCTGTACAAGTACAAGGTGGTGAAGATCGAG
CCCCTGGGCGTGGCCCCCACCCGCTGCAAGCGCCGCGTGGTGGGCCGCCGCCGCCGCCGCCGCGCCGTGGGCATCG
GCGCCGTGTTCCTGGGCTTCCTGGGCGCCGCCGGCTCCACCATGGGCGCCGCCTCCATGACCCTGACCGTGCAGGCC
CGCAACCTGCTGTCCGGCATCGTGCAGCAGCAGTCCAACCTGCTGCGCGCCCCCGAGGCCCAGCAGCACCTGCTGAA
GCTGACCGTGTGGGGCATCAAGCAGCTGCAGGCCCGCGTGCTGGCCGTGGAGCGCTACCTGCGCGACCAGCAGCTG
CTGGGCATCTGGGGCTGCTCCGGCAAGCTGATCTGCTGCACCAACGTGCCCTGGAACTCCTCCTGGTCCAACCGCAAC
CTGTCCGAGATCTGGGACAACATGACCTGGCTGCAGTGGGACAAGGAGATCTCCAACTACACCCAGATCATCTACGG
CCTGCTGGAGGAGTCCCAGAACCAGCAGGAGAAGAACGAGCAGGACCTGCTGGCCCTGGACtag >CH505w053.25chim.DS.6R.SOSIP.664 (SEQ ID NO. 228)

ATGGGCTCCCTGCAGCCCCTGGCCACCCTGTACCTGCTGGGCATGCTGGTGGCCTCCGTGCTGGCCGCCGAGAACCT
GTGGGTGACCGTGTACTACGGCGTGCCCGTGTGGAAGGAGGCCAAGACCACCCTGTTCTGCGCCTCCGACGCCAAG
GCCTACGAGAAGGAGGTGCACAACGTGTGGGCCACCCACGCCTGCGTGCCCACCGACCCCAACCCCCAGGAGATGG
TGCTGAAGAACGTGACCGAGAACTTCAACATGTGGGAGAACGACATGGTGGACCAGATGCACGAGGACGTGATCTC
CCTGTGGGACCAGTCCCTGAAGCCCTGCGTGAAGCTGACCCCCCTGTGCGTGACCCTGAACTGCACCGACGCCACCG
CCTCCAACGCCACCGCCTCCAACGCCACCGCCTCCAACTCCTCCATCATCGAGGGCATGAAGAACTGCTCCTTCAACAT
CACCACCGAGCTGCGCGACAAGCGCGAGAAGAAGAACGCCCTGTTCTACAAGCTGGACATCGTGCAGCTGGACGGC
AACTCCTCCCAGTACCGCCTGATCAACTGCAACACCTCCGTGTGCACCCAGGCCTGCCCCAAGGTGTCCTTCGACCCCA
TCCCCATCCACTACTGCGCCCCCGCCGGCTACGCCATCCTGAAGTGCAACAACAAGACCTTCAACGGCACCGGCCCCT
GCAACAACGTGTCCACCGTGCAGTGCACCCACGGCATCAAGCCCGTGGTGTCCACCCAGCTGCTGCTGAACGGCTCC
CTGGCCGAGGGCGAGATCATCATCCGCTCCGAGAACATCACCGACAACGGCAAGACCATCATCGTGCACCTGAACGA
GTCCGTGAAGATCGAGTGCACCCGCCCCTCCAACAACACCCGCACCTCCATCCGCATCGGCCCCGGCCAGGCCTTCTA
CGCCACCGGCCAGGTGATCGGCGACATCCGCGAGGCCCACTGCAACATCTCCGAGAACAAGTGGAACGAGACCCTG
CAGCGCGTGTCCAAGAAGCTGAAGGAGTACTTCCCCCACAAGAACATCACCTTCCAGCCCTCCTCCGGCGGCGACCTG
GAGATCACCACCCACTCCTTCAACTGCGGCGGCGAGTTCTTCTACTGCAACACCTCCTCCCTGTTCAACCGCACCTACA
TGGCCAACTCCACCGACATGGCCAACTCCACCGAGACCAACTCCACCCGCACCATCACCATCCGCTGCCGCATCAAGC
AGATCATCAACATGTGGCAGGAGGTGGGCCGCTGCATGTACGCCCCCCCCATCGCCGGCAACATCACCTGCATCTCCA
ACATCACCGGCCTGCTGCTGACCCGCGACGGCGGCAAGAACAA

Figure 22B cont.

CACCGAGACCTTCGAGACCTTCCGCCCCGGCGGCGGCAACATGAAGGACAACTGGCGCTCCGAGCTGTACAAGTACA
AGGTGGTGAAGATCGAGCCCCTGGGCGTGGCCCCCACCCGCTGCAAGCGCCGCGTGGTGGGCCGCCGCCGCCGCCG
CCGCGCCGTGGGCATCGGCGCCGTGTTCCTGGGCTTCCTGGGCGCCGCCGGCTCCACCATGGGCGCCGCCTCCATGA
CCCTGACCGTGCAGGCCCGCAACCTGCTGTCCGGCATCGTGCAGCAGCAGTCCAACCTGCTGCGCGCCCCCGAGGCC
CAGCAGCACCTGCTGAAGCTGACCGTGTGGGGCATCAAGCAGCTGCAGGCCCGCGTGCTGGCCGTGGAGCGCTACC
TGCGCGACCAGCAGCTGCTGGGCATCTGGGGCTGCTCCGGCAAGCTGATCTGCTGCACCAACGTGCCCTGGAACTCC
TCCTGGTCCAACCGCAACCTGTCCGAGATCTGGGACAACATGACCTGGCTGCAGTGGGACAAGGAGATCTCCAACTA
CACCCAGATCATCTACGGCCTGCTGGAGGAGTCCCAGAACCAGCAGGAGAAGAACGAGCAGGACCTGCTGGCCCTG
GACtag >CH505w053.25chim.6R.SOSIP.664v4.1 (SEQ ID NO. 229)

ATGGGCTCCCTGCAGCCCCTGGCCACCCTGTACCTGCTGGGCATGCTGGTGGCCTCCGTGCTGGCCGCCGAGAACCT
GTGGGTGACCGTGTACTACGGCGTGCCCGTGTGGAAGGAGGCCAAGACCACCCTGTTCTGCGCCTCCGACGCCAAG
GCCTACGAGAAGAAGGTGCACAACGTGTGGGCCACCCACGCCTGCGTGCCCACCGACCCCAACCCCCAGGAGATGG
TGCTGAAGAACGTGACCGAGAACTTCAACATGTGGGAGAACGACATGGTGGACCAGATGCACGAGGACGTGATCTC
CCTGTGGGACCAGTCCCTGAAGCCCTGCGTGAAGCTGACCCCCCTGTGCGTGACCCTGAACTGCACCGACGCCACCG
CCTCCAACGCCACCGCCTCCAACGCCACCGCCTCCAACTCCTCCATCATCGAGGGCATGAAGAACTGCTCCTTCAACAT
CACCACCGAGCTGCGCGACAAGCGCGAGAAGAAGAACGCCCTGTTCTACAAGCTGGACATCGTGCAGCTGGACGGC
AACTCCTCCCAGTACCGCCTGATCAACTGCAACACCTCCGTGATCACCCAGGCCTGCCCCAAGGTGTCCTTCGACCCCA
TCCCCATCCACTACTGCGCCCCCGCCGGCTACGCCATCCTGAAGTGCAACAACAAGACCTTCAACGGCACCGGCCCCT
GCAACAACGTGTCCACCGTGCAGTGCACCCACGGCATCAAGCCCGTGGTGTCCACCCAGCTGCTGCTGAACGGCTCC
CTGGCCGAGGGCGAGATCATCATCCGCTCCGAGAACATCACCGACAACGGCAAGACCATCATCGTGCACCTGAACGA
GTCCGTGAAGATCGAGTGCACCCGCCCCTCCAACAACACCCGCACCTCCATCCGCATCGGCCCCGGCCAGTGGTTCTA
CGCCACCGGCCAGGTGATCGGCGACATCCGCGAGGCCCACTGCAACATCTCCGAGAACAAGTGGAACGAGACCCTG
CAGCGCGTGTCCAAGAAGCTGAAGGAGTACTTCCCCCACAAGAACATCACCTTCCAGCCCTCCTCCGGCGGCGACCTG
GAGATCACCACCCACTCCTTCAACTGCGGCGGCGAGTTCTTCTACTGCAACACCTCCTCCCTGTTCAACCGCACCTACA
TGGCCAACTCCACCGACATGGCCAACTCCACCGAGACCAACTCCACCCGCACCATCACCATCCGCTGCCGCATCAAGC
AGATCATCAACATGTGGCAGGAGGTGGGCCGCGCCATGTACGCCCCCCCCATCGCCGGCAACATCACCTGCATCTCC
AACATCACCGGCCTGCTGCTGACCCGCGACGGCGGCAAGAACAACACCGAGACCTTCGAGACCTTCCGCCCCGGCGG
CGGCAACATGAAGGACAACTGGCGCTCCGAGCTGTACAAGTACAAGGTGGTGAAGATCGAGCCCCTGGGCGTGGCC
CCCACCCGCTGCAAGCGCCGCGTGGTGGGCCGCCGCCGCCGCCGCGCCGTGGGCATCGGCGCCGTGTTCCTGG
GCTTCCTGGGCGCCGCCGGCTCCACCATGGGCGCCGCCTCCATGACCCTGACCGTGCAGGCCCGCAACCTGCTGTCCG
GCATCGTGCAGCAGCAGTCCAACCTGCTGCGCGCCCCCGAGGCCCAGCAGCACCTGCTGAAGCTGACCGTGTGGGGC
ATCAAGCAGCTGCAGGCCCGCGTGCTGGCCGTGGAGCGCTACCTGCGCGACCAGCAGCTGCTGGGCATCTGGGGCT
GCTCCGGCAAGCTGATCTGCTGCACCAACGTGCCCTGGAACTCCTCCTGGTCCAACCGCAACCTGTCCGAGATCTGGG
ACAACATGACCTGGCTGCAGTGGGACAAGGAGATCTCCAACTACACCCAGATCATCTACGGCCTGCTGGAGGAGTCC
CAGAACCAGCAGGAGAAGAACGAGCAGGACCTGCTGGCCCTGGAC

Figure 22B cont.

>CH505w053.25chim.6R.SOSIP.664v4.2 (SEQ ID NO. 230)

ATGGGCTCCCTGCAGCCCCTGGCCACCCTGTACCTGCTGGGCATGCTGGTGGCCTCCGTGCTGGCCGCCGAGAACCT
GTGGGTGACCGTGTACTACGGCGTGCCCGTGTGGAAGGAGGCCAAGACCACCCTGTTCTGCGCCTCCGACGCCAAG
GCCTACGAGAAGGAGGTGCGCAACGTGTGGGCCACCCACGCCTGCGTGCCCACCGACCCCAACCCCCAGGAGATGG
TGCTGAAGAACGTGACCGAGAACTTCAACATGTGGGAGAACGACATGGTGGACCAGATGCACGAGGACGTGATCTC
CCTGTGGGACCAGTCCCTGAAGCCCTGCGTGAAGCTGACCCCCCTGTGCGTGACCCTGAACTGCACCGACGCCACCG
CCTCCAACGCCACCGCCTCCAACGCCACCGCCTCCAACTCCTCCATCATCGAGGGCATGAAGAACTGCTCCTTCAACAT
CACCACCGAGCTGCGCGACAAGCGCGAGAAGAAGAACGCCCTGTTCTACAAGCTGGACATCGTGCAGCTGGACGGC
AACTCCTCCCAGTACCGCCTGATCAACTGCAACACCTCCGTGATCACCCAGGCCTGCCCCAAGGTGTCCTTCGACCCCA
TCCCCATCCACTACTGCGCCCCCGCCGGCTACGCCATCCTGAAGTGCAACAACAAGACCTTCAACGGCACCGGCCCCT
GCAACAACGTGTCCACCGTGCAGTGCACCCACGGCATCAAGCCCGTGGTGTCCACCCAGCTGCTGCTGAACGGCTCC
CTGGCCGAGGGCGAGATCATCATCCGCTCCGAGAACATCACCGACAACGGCAAGACCATCATCGTGCACCTGAACGA
GTCCGTGAAGATCGAGTGCACCCGCCCCTCCAACAACACCCGCACCTCCATCCGCATCGGCCCCGGCCAGTGGTTCTA
CGCCACCGGCCAGGTGATCGGCGACATCCGCGAGGCCCACTGCAACATCTCCGAGAACAAGTGGAACGAGACCCTG
CAGCGCGTGTCCAAGAAGCTGAAGGAGTACTTCCCCCACAAGAACATCACCTTCCAGCCCTCCTCCGGCGGCGACCTG
GAGATCACCACCCACTCCTTCAACTGCGGCGGCGAGTTCTTCTACTGCAACACCTCCTCCCTGTTCAACCGCACCTACA
TGGCCAACTCCACCGACATGGCCAACTCCACCGAGACCAACTCCACCCGCACCATCACCATCCGCTGCCGCATCAAGC
AGATCATCAACATGTGGCAGGAGGTGGGCCGCGCCATGTACGCCCCCCCCATCGCCGGCAACATCACCTGCATCTCC
AACATCACCGGCCTGCTGCTGACCCGCGACGGCGGCAAGAACAACACCGAGACCTTCGAGACCTTCCGCCCCGGCGG
CGGCAACATGAAGGACAACTGGCGCTCCGAGCTGTACAAGTACAAGGTGGTGAAGATCGAGCCCCTGGGCGTGGCC
CCCACCCGCTGCAAGCGCCGCGTGGTGGGCCGCCGCCGCCGCCGCCGCGCCGTGGGCATCGGCGCCGTGTTCCTGG
GCTTCCTGGGCGCCGCCGGCTCCACCATGGGCGCCGCCTCCATGACCCTGACCGTGCAGGCCCGCAACCTGCTGTCCG
GCATCGTGCAGCAGCAGTCCAACCTGCTGCGCGCCCCCGAGGCCCAGCAGCACCTGCTGAAGCTGACCGTGTGGGGC
ATCAAGCAGCTGCAGGCCCGCGTGCTGGCCGTGGAGCGCTACCTGCGCGACCAGCAGCTGCTGGGCATCTGGGGCT
GCTCCGGCAAGCTGATCTGCTGCACCAACGTGCCCTGGAACTCCTCCTGGTCCAACCGCAACCTGTCCGAGATCTGGG
ACAACATGACCTGGCTGCAGTGGGACAAGGAGATCTCCAACTACACCCAGATCATCTACGGCCTGCTGGAGGAGTCC
CAGAACCAGCAGGAGAAGAACGAGCAGGACCTGCTGGCCCTGGACtag >CH505w053.29chim.6R.SOSIP.664 (SEQ ID NO. 231)

ATGGGCTCCCTGCAGCCCCTGGCCACCCTGTACCTGCTGGGCATGCTGGTGGCCTCCGTGCTGGCCGCCGAGAACCT
GTGGGTGACCGTGTACTACGGCGTGCCCGTGTGGAAGGAGGCCAAGACCACCCTGTTCTGCGCCTCCGACGCCAAG
GCCTACGAGAAGGAGGTGCACAACGTGTGGGCCACCCACGCCTGCGTGCCCACCGACCCCAACCCCCAGGAGATGG
TGCTGAAGAACGTGACCGAGAACTTCAACATGTGGAAGAACGACATGGTGGACCAGATGCACGAGGACGTGATCTC
CCTGTGGGACCAGTCCCTGAAGCCCTGCGTGAAGCTGACCCCCCTGTGCGTGACCCTGAACTGCACCGACGCCACCG
CCTCCAACGCCACCGCCATCAACTCCTCCATCATCGAGGGCATGAAGAACTGCTCCTTCAACATCACCACCGAGCTGC
GCGACAAGCGCGAGAAGAAGAACGCCCTGTTCTACAAGCTGGACATCGTGCAGCTGGACGGCAACTCCTCCCAGTAC
CGCCTGATCAACTGCAACACCTCCGTGATCACCCAGGCCTGCCCCAAGGTGTCCTTCGACCCCAT

Figure 22B cont.

CCCCATCCACTACTGCGCCCCCGCCGGCTACGCCATCCTGAAGTGCAACAACAAGACCTTCAACGGCACCGGCCCCTG
CAACAACGTGTCCACCGTGCAGTGCACCCACGGCATCAAGCCCGTGGTGTCCACCCAGCTGCTGCTGAACGGCTCCCT
GGCCGAGGGCGAGATCATCATCCGCTCCGAGAACATCACCAACAACGCCAAGACCATCATCGTGCACCTGAACGAGT
CCGTGAAGATCGAGTGCACCCGCCCCTCCAACAACACCCGCACCTCCATCCGCATCGGCCCCGGCCAGGCCTTCTACG
CCACCGGCCAGGTGATCGGCGACATCCGCGAGGCCCACTGCAACATCTCCGAGTCCAAGTGGAACGAGACCCTGCAG
CGCGTGTCCAAGAAGCTGAAGGAGTACTTCCCCCACAAGAACATCACCTTCCAGCCCTCCTCCGGCGGCGACCTGGA
GATCACCACCCACTCCTTCAACTGCGGCGGCGAGTTCTTCTACTGCAACACCTCCTCCCTGTTCAACCGCACCTACATG
GCCAACTCCACCGAGACCAACTCCACCCGCATCATCACCATCCGCTGCCGCATCAAGCAGATCATCAACATGTGGCAG
GAGGTGGGCCGCGCCATGTACGCCCCCCCCATCGCCGGCAACATCACCTGCATCTCCAACATCACCGGCCTGCTGCTG
ACCCGCGACGGCGGCAAGAACAACACCGAGACCTTCGAGACCTTCCGCCCCGAGGGCGGCAACATGAAGGACAACT
GGCGCTCCGAGCTGTACAAGTACAAGGTGGTGAAGATCGAGCCCCTGGGCGTGGCCCCCACCCGCTGCAAGCGCCG
CGTGGTGGGCCGCCGCCGCCGCCGCCGCGCCGTGGGCATCGGCGCCGTGTTCCTGGGCTTCCTGGGCGCCGCCGGC
TCCACCATGGGCGCCGCCTCCATGACCCTGACCGTGCAGGCCCGCAACCTGCTGTCCGGCATCGTGCAGCAGCAGTCC
AACCTGCTGCGCGCCCCCGAGGCCCAGCAGCACCTGCTGAAGCTGACCGTGTGGGGCATCAAGCAGCTGCAGGCCC
GCGTGCTGGCCGTGGAGCGCTACCTGCGCGACCAGCAGCTGCTGGGCATCTGGGGCTGCTCCGGCAAGCTGATCTG
CTGCACCAACGTGCCCTGGAACTCCTCCTGGTCCAACCGCAACCTGTCCGAGATCTGGGACAACATGACCTGGCTGCA
GTGGGACAAGGAGATCTCCAACTACACCCAGATCATCTACGGCCTGCTGGAGGAGTCCCAGAACCAGCAGGAGAAG
AACGAGCAGGACCTGCTGGCCCTGGACtag >CH505w053.29chim.6R.SOSIP.664v4.1 (SEQ ID NO. 232)

ATGGGCTCCCTGCAGCCCCTGGCCACCCTGTACCTGCTGGGCATGCTGGTGGCCTCCGTGCTGGCCGCCGAGAACCT
GTGGGTGACCGTGTACTACGGCGTGCCCGTGTGGAAGGAGGCCAAGACCACCCTGTTCTGCGCCTCCGACGCCAAG
GCCTACGAGAAGGAGGTGCACAACGTGTGGGCCACCCACGCCTGCGTGCCCACCGACCCCAACCCCCAGGAGATGG
TGCTGAAGAACGTGACCGAGAACTTCAACATGTGGAAGAACGACATGGTGGACCAGATGCACGAGGACGTGATCTC
CCTGTGGGACCAGTCCCTGAAGCCCTGCGTGAAGCTGACCCCCCTGTGCGTGACCCTGAACTGCACCGACGCCACCG
CCTCCAACGCCACCGCCATCAACTCCTCCATCATCGAGGGCATGAAGAACTGCTCCTTCAACATCACCACCGAGCTGC
GCGACAAGCGCGAGAAGAAGAACGCCCTGTTCTACAAGCTGGACATCGTGCAGCTGGACGGCAACTCCTCCCAGTAC
CGCCTGATCAACTGCAACACCTCCGTGATCACCCAGGCCTGCCCCAAGGTGTCCTTCGACCCCATCCCCATCCACTACT
GCGCCCCCGCCGGCTACGCCATCCTGAAGTGCAACAACAAGACCTTCAACGGCACCGGCCCCTGCAACAACGTGTCC
ACCGTGCAGTGCACCCACGGCATCAAGCCCGTGGTGTCCACCCAGCTGCTGCTGAACGGCTCCCTGGCCGAGGGCGA
GATCATCATCCGCTCCGAGAACATCACCAACAACGCCAAGACCATCATCGTGCACCTGAACGAGTCCGTGAAGATCGA
GTGCACCCGCCCCTCCAACAACACCCGCACCTCCATCCGCATCGGCCCCGGCCAGTGGTTCTACGCCACCGGCCAGGT
GATCGGCGACATCCGCGAGGCCCACTGCAACATCTCCGAGTCCAAGTGGAACGAGACCCTGCAGCGCGTGTCCAAGA
AGCTGAAGGAGTACTTCCCCCACAAGAACATCACCTTCCAGCCCTCCTCCGGCGGCGACCTGGAGATCACCACCCACT
CCTTCAACTGCGGCGGCGAGTTCTTCTACTGCAACACCTCCTCCCTGTTCAACCGCACCTACATGGCCAACTCCACCGA
GACCAACTCCACCCGCATCATCACCATCCGCTGCCGCATCAAGCAGATCATCAACATGTGGCAGGAGGTGGGCCGCG
CCATGTACGCCCCCCCCATCGCCGGCAACATCACCTGCATCTCCAACATCACCGGCCTGCTGCTGACCCGCGACGGCG
GCAAGAACAACACCGAGACCTTCGAGACCTTCCGCCCCGAGGGC

Figure 22B cont.

GGCAACATGAAGGACAACTGGCGCTCCGAGCTGTACAAGTACAAGGTGGTGAAGATCGAGCCCCTGGGCGTGGCCC
CCACCCGCTGCAAGCGCCGCGTGGTGGGCCGCCGCCGCCGCCGCCGCGCCGTGGGCATCGGCGCCGTGTTCCTGGG
CTTCCTGGGCGCCGCCGGCTCCACCATGGGCGCCGCCTCCATGACCCTGACCGTGCAGGCCCGCAACCTGCTGTCCGG
CATCGTGCAGCAGCAGTCCAACCTGCTGCGCGCCCCCGAGGCCCAGCAGCACCTGCTGAAGCTGACCGTGTGGGGCA
TCAAGCAGCTGCAGGCCCGCGTGCTGGCCGTGGAGCGCTACCTGCGCGACCAGCAGCTGCTGGGCATCTGGGGCTG
CTCCGGCAAGCTGATCTGCTGCACCAACGTGCCCTGGAACTCCTCCTGGTCCAACCGCAACCTGTCCGAGATCTGGGA
CAACATGACCTGGCTGCAGTGGGACAAGGAGATCTCCAACTACACCCAGATCATCTACGGCCTGCTGGAGGAGTCCC
AGAACCAGCAGGAGAAGAACGAGCAGGACCTGCTGGCCCTGGACtag >CH505w053.29chim.6R.SOSIP.664v4.2 (SEQ ID NO. 233)

ATGGGCTCCCTGCAGCCCCTGGCCACCCTGTACCTGCTGGGCATGCTGGTGGCCTCCGTGCTGGCCGCCGAGAACCT
GTGGGTGACCGTGTACTACGGCGTGCCCGTGTGGAAGGAGGCCAAGACCACCCTGTTCTGCGCCTCCGACGCCAAG
GCCTACGAGAAGGAGGTGCGCAACGTGTGGGCCACCCACGCCTGCGTGCCCACCGACCCCAACCCCCAGGAGATGG
TGCTGAAGAACGTGACCGAGAACTTCAACATGTGGAAGAACGACATGGTGGACCAGATGCACGAGGACGTGATCTC
CCTGTGGGACCAGTCCCTGAAGCCCTGCGTGAAGCTGACCCCCCTGTGCGTGACCCTGAACTGCACCGACGCCACCG
CCTCCAACGCCACCGCCATCAACTCCTCCATCATCGAGGGCATGAAGAACTGCTCCTTCAACATCACCACCGAGCTGC
GCGACAAGCGCGAGAAGAAGAACGCCCTGTTCTACAAGCTGGACATCGTGCAGCTGGACGGCAACTCCTCCCAGTAC
CGCCTGATCAACTGCAACACCTCCGTGATCACCCAGGCCTGCCCCAAGGTGTCCTTCGACCCCATCCCCATCCACTACT
GCGCCCCCGCCGGCTACGCCATCCTGAAGTGCAACAACAAGACCTTCAACGGCACCGGCCCCTGCAACAACGTGTCC
ACCGTGCAGTGCACCCACGGCATCAAGCCCGTGGTGTCCACCCAGCTGCTGCTGAACGGCTCCCTGGCCGAGGGCGA
GATCATCATCCGCTCCGAGAACATCACCAACAACGCCAAGACCATCATCGTGCACCTGAACGAGTCCGTGAAGATCGA
GTGCACCCGCCCCTCCAACAACACCCGCACCTCCATCCGCATCGGCCCCGGCCAGTGGTTCTACGCCACCGGCCAGGT
GATCGGCGACATCCGCGAGGCCCACTGCAACATCTCCGAGTCCAAGTGGAACGAGACCCTGCAGCGCGTGTCCAAGA
AGCTGAAGGAGTACTTCCCCCACAAGAACATCACCTTCCAGCCCTCCTCCGGCGGCGACCTGGAGATCACCACCCACT
CCTTCAACTGCGGCGGCGAGTTCTTCTACTGCAACACCTCCTCCCTGTTCAACCGCACCTACATGGCCAACTCCACCGA
GACCAACTCCACCCGCATCATCACCATCCGCTGCCGCATCAAGCAGATCATCAACATGTGGCAGGAGGTGGGCCGCG
CCATGTACGCCCCCCCCATCGCCGGCAACATCACCTGCATCTCCAACATCACCGGCCTGCTGCTGACCCGCGACGGCG
GCAAGAACAACACCGAGACCTTCGAGACCTTCCGCCCCGAGGGCGGCAACATGAAGGACAACTGGCGCTCCGAGCT
GTACAAGTACAAGGTGGTGAAGATCGAGCCCCTGGGCGTGGCCCCCACCCGCTGCAAGCGCCGCGTGGTGGGCCGC
CGCCGCCGCCGCCGCGCCGTGGGCATCGGCGCCGTGTTCCTGGGCTTCCTGGGCGCCGCCGGCTCCACCATGGGCGC
CGCCTCCATGACCCTGACCGTGCAGGCCCGCAACCTGCTGTCCGGCATCGTGCAGCAGCAGTCCAACCTGCTGCGCGC
CCCCGAGGCCCAGCAGCACCTGCTGAAGCTGACCGTGTGGGGCATCAAGCAGCTGCAGGCCCGCGTGCTGGCCGTG
GAGCGCTACCTGCGCGACCAGCAGCTGCTGGGCATCTGGGGCTGCTCCGGCAAGCTGATCTGCTGCACCAACGTGCC
CTGGAACTCCTCCTGGTCCAACCGCAACCTGTCCGAGATCTGGGACAACATGACCTGGCTGCAGTGGGACAAGGAGA
TCTCCAACTACACCCAGATCATCTACGGCCTGCTGGAGGAGTCCCAGAACCAGCAGGAGAAGAACGAGCAGGACCTG
CTGGCCCTGGACtag

Figure 22B cont.

Translate results
>HV1301180, CH505TFchim.6R.SOSIP.664 (SEQ ID NO. 234)
MPMGSLQPLATLYLLGMLVASVLAAENLWVTVYYGVPVWKEAKTTLFCASDAKAYEKEVH
NVWATHACVPTDPNPQEMVLKNVTENFNMWKNDMVDQMHEDVISLWDQSLKPCVKLTPLC
VTLNCTNATASNSSIIEGMKNCSFNITTELRDKREKKNALFYKLDIVQLDGNSSQYRLIN
CNTSVITQACPKVSFDPIPIHYCAPAGYAILKCNNKTFTGTGPCNNVSTVQCTHGIKPVV
STQLLLNGSLAEGEIIIRSENITNNVKTIIVHLNESVKIECTRPNNKTRTSIRIGPGQAF
YATGQVIGDIREAYCNINESKWNETLQRVSKKLKEYFPHKNITFQPSSGGDLEITTHSFN
CGGEFFYCNTSSLFNRTYMANSTDMANSTETNSTRTITIHCRIKQIINMWQEVGRAMYAP
PIAGNITCISNITGLLLTRDGGKNNTETFRPGGGNMKDNWRSELYKYKVVKIEPLGVAPT
RCKRRVVGRRRRRRAVGIGAVFLGFLGAAGSTMGAASMTLTVQARNLLSGIVQQQSNLLR
APEAQQHLLKLTVWGIKQLQARVLAVERYLRDQQLLGIWGCSGKLICCTNVPWNSSWSNR
NLSEIWDNMTWLQWDKEISNYTQIIYGLLEESQNQQEKNEQDLLALD**

>HV1301181, CH505w53.16chim.6R.SOSIP.664 (SEQ ID NO. 235)
MGSLQPLATLYLLGMLVASVLAAENLWVTVYYGVPVWKEAKTTLFCASDAKAYEKEVHNV
WATHACVPTDPNPQEMVLKNVTENFNMWKNDMVDQMHEDVISLWDQSLKPCVKLTPLCVT
LNCTNANATASNSSIIEGMNSSIIEGMKNCSFNITTELRDKREKKNALFYKLDIVQLDGN
SSQYRLINCNTSVITQACPKVSFDPIPIHYCAPAGYAILKCNNKTFNGTGPCNNVSTVQC
THGIKPVVSTQLLLNGSLAEGEIIIRSENITDNGKTIIVHLNESVKIECTRPSNNTRTSI
RIGPGQAFYATGQVIGDIREAHCNISESKWNETLQRVSEKLKEYFPHKNITFQPSSGGDL
EITTHSFNCGGEFFYCNTSSLFNRTYMATSTDMANSTETNSTRIITIRCRIKQIINMWQE
VGRAMYAPPIAGNITCISNITGLLLTRDGGKNNTETFETFRPGGGNMKDNWRSELYKYKV
VKIEPLGVAPTRCKRRVVGRRRRRRAVGIGAVFLGFLGAAGSTMGAASMTLTVQARNLLS
GIVQQQSNLLRAPEAQQHLLKLTVWGIKQLQARVLAVERYLRDQQLLGIWGCSGKLICCT
NVPWNSSWSNRNLSEIWDNMTWLQWDKEISNYTQIIYGLLEESQNQQEKNEQDLLALD*

>HV1301182, CH505w78.33chim.6R.SOSIP.664 (SEQ ID NO. 236)
MGSLQPLATLYLLGMLVASVLAAENLWVTVYYGVPVWKEAKTTLFCASDAKAYEKEVHNV
WATHACVPTDPNPQEMVLKNVTENFNMWKNDMADQMHEDVISLWDQSLKPCVKLTPLCVT
LNCIDANATASNATASNSSIIEGMKNCSFNITTELRDKIEKKNALFYKLDIVQLDGNSSQ
YRLINCNTSVITQACPKVSFDPIPIHYCAPAGYAILKCNNKTFNGTGPCNNVSTVQCTHG
IKPVVSTQLLLNGSLAEGEIIIRSENITNSAKTIIVHLNESVKIECTRPSNNTRTSIRIG
PGQAFYATGQVIGDIRKAHCNISESKWNETLQRVSKKLKEYFPHKNITFQPSSGGDLEIT
THSFNCGGEFFYCNTSSLFNRTYMANSTETNSTRTITLHCRIKQIINMWQEVGRAMYAPP
IAGNITCISNITGLLLTRDGGNNNTTETFRPGGGNMKDNWRSELYKYKVVKIEPLGVAPT
RCKRRVVGRRRRRRAVGIGAVFLGFLGAAGSTMGAASMTLTVQARNLLSGIVQQQSNLLR
APEAQQHLLKLTVWGIKQLQARVLAVERYLRDQQLLGIWGCSGKLICCTNVPWNSSWSNR
NLSEIWDNMTWLQWDKEISNYTQIIYGLLEESQNQQEKNEQDLLALD*

>HV1301183, CH505w100.B6chim.6R.SOSIP.664 (SEQ ID NO. 237)
MGSLQPLATLYLLGMLVASVLAAENLWVTVYYGVPVWKEAKTTLFCASDAKAYEKEVHNV
WATHACVPTDPNPQEMVLENVTENFNMWKNDMADQMHEDVISLWDQSLKPCVKLTPLCVT
LNCTDANATASNTNATASNINATASKSSIIEEMKNCSFNITTELRDKREKKYALFYKLDI
VQLDGNSSQYRLINCNTSVITQACPKVSFDPIPIHYCAPAGYAILKCNNKTFNGTGPCNN
VSTVQCTHGIKPVVSTQLLLNGSLAEGEIIIRSENITDNSKTIIVHLNESVKIECTRPSN
NTRTSIRIGPGQAFYATGQVIGDIREAHCNISESKWNETLQRVSKKLKEYFPDKNITFQP
SSGGDPEITTHSFNCGGEFFYCNTSSLFNRTYMANSTETNSTRTITLHCRIKQIINMWQE
VGRAMYAPPIAGNITCISNITGLLLTRDGGENTRDGGNNNTETFRPEGGNMKDNWRSELY
KYKVVKIEPLGVAPTRCKRRVVGRRRRRRAVGIGAVFLGFLGAAGSTMGAASMTLTVQAR
NLLSGIVQQQSNLLRAPEAQQHLLKLTVWGIKQLQARVLAVERYLRDQQLLGIWGCSGKL
ICCTNVPWNSSWSNRNLSEIWDNMTWLQWDKEISNYTQIIYGLLEESQNQQEKNEQDLLA
LD*

Figure 23A

>HV1301143, CH505TFchim.DS.6R.SOSIP.664 (SEQ ID NO. 238)
MPMGSLQPLATLYLLGMLVASVLAAENLWVTVYYGVPVWKEAKTTLFCASDAKAYEKEVH
NVWATHACVPTDPNPQEMVLKNVTENFNMWKNDMVDQMHEDVISLWDQSLKPCVKLTPLC
VTLNCTNATASNSSIIEGMKNCSFNITTELRDKREKKNALFYKLDIVQLDGNSSQYRLIN
CNTSVCTQACPKVSFDPIPIHYCAPAGYAILKCNNKTFTGTGPCNNVSTVQCTHGIKPVV
STQLLLNGSLAEGEIIIRSENITNNVKTIIVHLNESVKIECTRPNNKTRTSIRIGPGQAF
YATGQVIGDIREAYCNINESKWNETLQRVSKKLKEYFPHKNITFQPSSGGDLEITTHSFN
CGGEFFYCNTSSLFNRTYMANSTDMANSTETNSTRTITIHCRIKQIINMWQEVGRCMYAP
PIAGNITCISNITGLLLTRDGGKNNTETFRPGGGNMKDNWRSELYKYKVVKIEPLGVAPT
RCKRRVVGRRRRRRAVGIGAVFLGFLGAAGSTMGAASMTLTVQARNLLSGIVQQQSNLLR
APEAQQHLLKLTVWGIKQLQARVLAVERYLRDQQLLGIWGCSGKLICCTNVPWNSSWSNR
NLSEIWDNMTWLQWDKEISNYTQIIYGLLEESQNQQEKNEQDLLALD**

>HV1301144, CH505w53.16chim.DS.6R.SOSIP.664 (SEQ ID NO. 239)
MGSLQPLATLYLLGMLVASVLAAENLWVTVYYGVPVWKEAKTTLFCASDAKAYEKEVHNV
WATHACVPTDPNPQEMVLKNVTENFNMWKNDMVDQMHEDVISLWDQSLKPCVKLTPLCVT
LNCTNANATASNSSIIEGMNSSIIEGMKNCSFNITTELRDKREKKNALFYKLDIVQLDGN
SSQYRLINCNTSVCTQACPKVSFDPIPIHYCAPAGYAILKCNNKTFNGTGPCNNVSTVQC
THGIKPVVSTQLLLNGSLAEGEIIIRSENITDNGKTIIVHLNESVKIECTRPSNNTRTSI
RIGPGQAFYATGQVIGDIREAHCNISESKWNETLQRVSEKLKEYFPHKNITFQPSSGGDL
EITTHSFNCGGEFFYCNTSSLFNRTYMATSTDMANSTETNSTRIITIRCRIKQIINMWQE
VGRCMYAPPIAGNITCISNITGLLLTRDGGKNNTETFETFRPGGGNMKDNWRSELYKYKV
VKIEPLGVAPTRCKRRVVGRRRRRRAVGIGAVFLGFLGAAGSTMGAASMTLTVQARNLLS
GIVQQQSNLLRAPEAQQHLLKLTVWGIKQLQARVLAVERYLRDQQLLGIWGCSGKLICCT
NVPWNSSWSNRNLSEIWDNMTWLQWDKEISNYTQIIYGLLEESQNQQEKNEQDLLALD*

>HV1301145, CH505w78.33chim.DS.6R.SOSIP.664 (SEQ ID NO. 240)
MGSLQPLATLYLLGMLVASVLAAENLWVTVYYGVPVWKEAKTTLFCASDAKAYEKEVHNV
WATHACVPTDPNPQEMVLKNVTENFNMWKNDMADQMHEDVISLWDQSLKPCVKLTPLCVT
LNCIDANATASNATASNSSIIEGMKNCSFNITTELRDKIEKKNALFYKLDIVQLDGNSSQ
YRLINCNTSVCTQACPKVSFDPIPIHYCAPAGYAILKCNNKTFNGTGPCNNVSTVQCTHG
IKPVVSTQLLLNGSLAEGEIIIRSENITNSAKTIIVHLNESVKIECTRPSNNTRTSIRIG
PGQAFYATGQVIGDIRKAHCNISESKWNETLQRVSKKLKEYFPHKNITFQPSSGGDLEIT
THSFNCGGEFFYCNTSSLFNRTYMANSTETNSTRTITLHCRIKQIINMWQEVGRCMYAPP
IAGNITCISNITGLLLTRDGGNNNTTETFRPGGGNMKDNWRSELYKYKVVKIEPLGVAPT
RCKRRVVGRRRRRRAVGIGAVFLGFLGAAGSTMGAASMTLTVQARNLLSGIVQQQSNLLR
APEAQQHLLKLTVWGIKQLQARVLAVERYLRDQQLLGIWGCSGKLICCTNVPWNSSWSNR
NLSEIWDNMTWLQWDKEISNYTQIIYGLLEESQNQQEKNEQDLLALD*

>HV1301146, CH505w100chim.B6.DS.6R.SOSIP.664 (SEQ ID NO. 241)
MGSLQPLATLYLLGMLVASVLAAENLWVTVYYGVPVWKEAKTTLFCASDAKAYEKEVHNV
WATHACVPTDPNPQEMVLENVTENFNMWKNDMADQMHEDVISLWDQSLKPCVKLTPLCVT
LNCTDANATASNTNATASNINATASKSSIIEEMKNCSFNITTELRDKREKKYALFYKLDI
VQLDGNSSQYRLINCNTSVCTQACPKVSFDPIPIHYCAPAGYAILKCNNKTFNGTGPCNN
VSTVQCTHGIKPVVSTQLLLNGSLAEGEIIIRSENITDNSKTIIVHLNESVKIECTRPSN
NTRTSIRIGPGQAFYATGQVIGDIREAHCNISESKWNETLQRVSKKLKEYFPDKNITFQP
SSGGDPEITTHSFNCGGEFFYCNTSSLFNRTYMANSTETNSTRTITLHCRIKQIINMWQE
VGRCMYAPPIAGNITCISNITGLLLTRDGGENTRDGGNNNTETFRPEGGNMKDNWRSELY
KYKVVKIEPLGVAPTRCKRRVVGRRRRRRAVGIGAVFLGFLGAAGSTMGAASMTLTVQAR
NLLSGIVQQQSNLLRAPEAQQHLLKLTVWGIKQLQARVLAVERYLRDQQLLGIWGCSGKL
ICCTNVPWNSSWSNRNLSEIWDNMTWLQWDKEISNYTQIIYGLLEESQNQQEKNEQDLLA
LD*

Figure 23A cont.

>HV1301288, CH505M5chim.6R.SOSIP.664v4.1 (SEQ ID NO. 242)
MPMGSLQPLATLYLLGMLVASVLAAENLWVTVYYGVPVWKEAKTTLFCASDAKAYEKKVH
NVWATHACVPTDPNPQEMVLKNVTENFNMWKNDMVDQMHEDVISLWDQSLKPCVKLTPLC
VTLNCTNATASNSSIIEGMKNCSFNITTELRDKREKKNALFYKLDIVQLDGNSSQYRLIN
CNTSVITQACPKVSFDPIPIHYCAPAGYAILKCNNKTFTGTGPCNNVSTVQCTHGIKPVV
STQLLLNGSLAEGEIIIRSENITKNVKTIIVHLNESVKIECTRPNNKTRTSIRIGPGQWF
YATGQVIGDIREAYCNINESKWNETLQRVSKKLKEYFPHKNITFQPSSGGDLEITTHSFN
CGGEFFYCNTSSLFNRTYMANSTDMANSTETNSTRTITIHCRIKQIINMWQEVGRAMYAP
PIAGNITCISNITGLLLTRDGGKNNTETFRPGGGNMKDNWRSELYKYKVVKIEPLGVAPT
RCKRRVVGRRRRRRAVGIGAVFLGFLGAAGSTMGAASMTLTVQARNLLSGIVQQQSNLLR
APEAQQHLLKLTVWGIKQLQARVLAVERYLRDQQLLGIWGCSGKLICCTNVPWNSSWSNR
NLSEIWDNMTWLQWDKEISNYTQIIYGLLEESQNQQEKNEQDLLALD*

>HV1301297, CH505M5chim.6R.SOSIP.664v4.2 (SEQ ID NO. 243)
MPMGSLQPLATLYLLGMLVASVLAAENLWVTVYYGVPVWKEAKTTLFCASDAKAYEKEVR
NVWATHACVPTDPNPQEMVLKNVTENFNMWKNDMVDQMHEDVISLWDQSLKPCVKLTPLC
VTLNCTNATASNSSIIEGMKNCSFNITTELRDKREKKNALFYKLDIVQLDGNSSQYRLIN
CNTSVITQACPKVSFDPIPIHYCAPAGYAILKCNNKTFTGTGPCNNVSTVQCTHGIKPVV
STQLLLNGSLAEGEIIIRSENITKNVKTIIVHLNESVKIECTRPNNKTRTSIRIGPGQWF
YATGQVIGDIREAYCNINESKWNETLQRVSKKLKEYFPHKNITFQPSSGGDLEITTHSFN
CGGEFFYCNTSSLFNRTYMANSTDMANSTETNSTRTITIHCRIKQIINMWQEVGRAMYAP
PIAGNITCISNITGLLLTRDGGKNNTETFRPGGGNMKDNWRSELYKYKVVKIEPLGVAPT
RCKRRVVGRRRRRRAVGIGAVFLGFLGAAGSTMGAASMTLTVQARNLLSGIVQQQSNLLR
APEAQQHLLKLTVWGIKQLQARVLAVERYLRDQQLLGIWGCSGKLICCTNVPWNSSWSNR
NLSEIWDNMTWLQWDKEISNYTQIIYGLLEESQNQQEKNEQDLLALD*

>HV1301289, CH505M11chim.6R.SOSIP.664v4.1 (SEQ ID NO. 244)
MPMGSLQPLATLYLLGMLVASVLAAENLWVTVYYGVPVWKEAKTTLFCASDAKAYEKKVH
NVWATHACVPTDPNPQEMVLKNVTENFNMWKNDMVDQMHEDVISLWDQSLKPCVKLTPLC
VTLNCTNATASNSSIIEGMKNCSFNITTELRDKREKKNALFYKLDIVQLDGNSSQYRLIN
CNTSVITQACPKVSFDPIPIHYCAPAGYAILKCNNKTFTGTGPCNNVSTVQCTHGIKPVV
STQLLLNGSLAEGEIIIRSENITDNGKTIIVHLNESVKIECTRPNNKTRTSIRIGPGQWF
YATGQVIGDIREAYCNINESKWNETLQRVSKKLKEYFPHKNITFQPSSGGDLEITTHSFN
CGGEFFYCNTSSLFNRTYMANSTDMANSTETNSTRTITIHCRIKQIINMWQEVGRAMYAP
PIAGNITCISNITGLLLTRDGGKNNTETFRPGGGNMKDNWRSELYKYKVVKIEPLGVAPT
RCKRRVVGRRRRRRAVGIGAVFLGFLGAAGSTMGAASMTLTVQARNLLSGIVQQQSNLLR
APEAQQHLLKLTVWGIKQLQARVLAVERYLRDQQLLGIWGCSGKLICCTNVPWNSSWSNR
NLSEIWDNMTWLQWDKEISNYTQIIYGLLEESQNQQEKNEQDLLALD*

>HV1301298, CH505M11chim.6R.SOSIP.664v4.2 (SEQ ID NO. 245)
MPMGSLQPLATLYLLGMLVASVLAAENLWVTVYYGVPVWKEAKTTLFCASDAKAYEKEVR
NVWATHACVPTDPNPQEMVLKNVTENFNMWKNDMVDQMHEDVISLWDQSLKPCVKLTPLC
VTLNCTNATASNSSIIEGMKNCSFNITTELRDKREKKNALFYKLDIVQLDGNSSQYRLIN
CNTSVITQACPKVSFDPIPIHYCAPAGYAILKCNNKTFTGTGPCNNVSTVQCTHGIKPVV
STQLLLNGSLAEGEIIIRSENITDNGKTIIVHLNESVKIECTRPNNKTRTSIRIGPGQWF
YATGQVIGDIREAYCNINESKWNETLQRVSKKLKEYFPHKNITFQPSSGGDLEITTHSFN
CGGEFFYCNTSSLFNRTYMANSTDMANSTETNSTRTITIHCRIKQIINMWQEVGRAMYAP
PIAGNITCISNITGLLLTRDGGKNNTETFRPGGGNMKDNWRSELYKYKVVKIEPLGVAPT
RCKRRVVGRRRRRRAVGIGAVFLGFLGAAGSTMGAASMTLTVQARNLLSGIVQQQSNLLR
APEAQQHLLKLTVWGIKQLQARVLAVERYLRDQQLLGIWGCSGKLICCTNVPWNSSWSNR
NLSEIWDNMTWLQWDKEISNYTQIIYGLLEESQNQQEKNEQDLLALD*

Figure 23A cont.

>HV1301290, CH505w053.16.chim.6R.SOSIP.664v4.1 (SEQ ID NO. 246)
MPMGSLQPLATLYLLGMLVASVLAAENLWVTVYYGVPVWKEAKTTLFCASDAKAYEKKVH
NVWATHACVPTDPNPQEMVLKNVTENFNMWKNDMVDQMHEDVISLWDQSLKPCVKLTPLC
VTLNCTNANATASNSSIIEGMNSSIIEGMKNCSFNITTELRDKREKKNALFYKLDIVQLD
GNSSQYRLINCNTSVITQACPKVSFDPIPIHYCAPAGYAILKCNNKTFNGTGPCNNVSTV
QCTHGIKPVVSTQLLLNGSLAEGEIIIRSENITDNGKTIIVHLNESVKIECTRPSNNTRT
SIRIGPGQWFYATGQVIGDIREAHCNISESKWNETLQRVSEKLKEYFPHKNITFQPSSGG
DLEITTHSFNCGGEFFYCNTSSLFNRTYMATSTDMANSTETNSTRIITIRCRIKQIINMW
QEVGRAMYAPPIAGNITCISNITGLLLTRDGGKNNTETFETFRPGGGNMKDNWRSELYKY
KVVKIEPLGVAPTRCKRRVVGRRRRRRAVGIGAVFLGFLGAAGSTMGAASMTLTVQARNL
LSGIVQQQSNLLRAPEAQQHLLKLTVWGIKQLQARVLAVERYLRDQQLLGIWGCSGKLIC
CTNVPWNSSWSNRNLSEIWDNMTWLQWDKEISNYTQIIYGLLEESQNQQEKNEQDLLALD
*

>HV1301299, CH505w053.16.chim.6R.SOSIP.664v4.2 (SEQ ID NO. 247)
MPMGSLQPLATLYLLGMLVASVLAAENLWVTVYYGVPVWKEAKTTLFCASDAKAYEKEVR
NVWATHACVPTDPNPQEMVLKNVTENFNMWKNDMVDQMHEDVISLWDQSLKPCVKLTPLC
VTLNCTNANATASNSSIIEGMNSSIIEGMKNCSFNITTELRDKREKKNALFYKLDIVQLD
GNSSQYRLINCNTSVITQACPKVSFDPIPIHYCAPAGYAILKCNNKTFNGTGPCNNVSTV
QCTHGIKPVVSTQLLLNGSLAEGEIIIRSENITDNGKTIIVHLNESVKIECTRPSNNTRT
SIRIGPGQWFYATGQVIGDIREAHCNISESKWNETLQRVSEKLKEYFPHKNITFQPSSGG
DLEITTHSFNCGGEFFYCNTSSLFNRTYMATSTDMANSTETNSTRIITIRCRIKQIINMW
QEVGRAMYAPPIAGNITCISNITGLLLTRDGGKNNTETFETFRPGGGNMKDNWRSELYKY
KVVKIEPLGVAPTRCKRRVVGRRRRRRAVGIGAVFLGFLGAAGSTMGAASMTLTVQARNL
LSGIVQQQSNLLRAPEAQQHLLKLTVWGIKQLQARVLAVERYLRDQQLLGIWGCSGKLIC
CTNVPWNSSWSNRNLSEIWDNMTWLQWDKEISNYTQIIYGLLEESQNQQEKNEQDLLALD
*

>HV1301291, CH505w078.33.chim.6R.SOSIP.664v4.1 (SEQ ID NO. 248)
MPMGSLQPLATLYLLGMLVASVLAAENLWVTVYYGVPVWKEAKTTLFCASDAKAYEKKVH
NVWATHACVPTDPNPQEMVLKNVTENFNMWKNDMADQMHEDVISLWDQSLKPCVKLTPLC
VTLNCIDANATASNATASNSSIIEGMKNCSFNITTELRDKIEKKNALFYKLDIVQLDGNS
SQYRLINCNTSVITQACPKVSFDPIPIHYCAPAGYAILKCNNKTFNGTGPCNNVSTVQCT
HGIKPVVSTQLLLNGSLAEGEIIIRSENITNSAKTIIVHLNESVKIECTRPSNNTRTSIR
IGPGQWFYATGQVIGDIRKAHCNISESKWNETLQRVSKKLKEYFPHKNITFQPSSGGDLE
ITTHSFNCGGEFFYCNTSSLFNRTYMANSTETNSTRTITLHCRIKQIINMWQEVGRAMYA
PPIAGNITCISNITGLLLTRDGGNNNTTETFRPGGGNMKDNWRSELYKYKVVKIEPLGVA
PTRCKRRVVGRRRRRRAVGIGAVFLGFLGAAGSTMGAASMTLTVQARNLLSGIVQQQSNL
LRAPEAQQHLLKLTVWGIKQLQARVLAVERYLRDQQLLGIWGCSGKLICCTNVPWNSSWS
NRNLSEIWDNMTWLQWDKEISNYTQIIYGLLEESQNQQEKNEQDLLALD*

>HV1301300, CH505w078.33.chim.6R.SOSIP.664v4.2 (SEQ ID NO. 249)
MPMGSLQPLATLYLLGMLVASVLAAENLWVTVYYGVPVWKEAKTTLFCASDAKAYEKEVR
NVWATHACVPTDPNPQEMVLKNVTENFNMWKNDMADQMHEDVISLWDQSLKPCVKLTPLC
VTLNCIDANATASNATASNSSIIEGMKNCSFNITTELRDKIEKKNALFYKLDIVQLDGNS
SQYRLINCNTSVITQACPKVSFDPIPIHYCAPAGYAILKCNNKTFNGTGPCNNVSTVQCT
HGIKPVVSTQLLLNGSLAEGEIIIRSENITNSAKTIIVHLNESVKIECTRPSNNTRTSIR
IGPGQWFYATGQVIGDIRKAHCNISESKWNETLQRVSKKLKEYFPHKNITFQPSSGGDLE
ITTHSFNCGGEFFYCNTSSLFNRTYMANSTETNSTRTITLHCRIKQIINMWQEVGRAMYA
PPIAGNITCISNITGLLLTRDGGNNNTTETFRPGGGNMKDNWRSELYKYKVVKIEPLGVA
PTRCKRRVVGRRRRRRAVGIGAVFLGFLGAAGSTMGAASMTLTVQARNLLSGIVQQQSNL
LRAPEAQQHLLKLTVWGIKQLQARVLAVERYLRDQQLLGIWGCSGKLICCTNVPWNSSWS
NRNLSEIWDNMTWLQWDKEISNYTQIIYGLLEESQNQQEKNEQDLLALD*

Figure 23A cont.

>HV1301292, CH505w100.B6chim.6R.SOSIP.664v4.1 (SEQ ID NO. 250)
MPMGSLQPLATLYLLGMLVASVLAAENLWVTVYYGVPVWKEAKTTLFCASDAKAYEKKVH
NVWATHACVPTDPNPQEMVLENVTENFNMWKNDMADQMHEDVISLWDQSLKPCVKLTPLC
VTLNCTDANATASNTNATASNINATASKSSIIEEMKNCSFNITTELRDKREKKYALFYKL
DIVQLDGNSSQYRLINCNTSVITQACPKVSFDPIPIHYCAPAGYAILKCNNKTFNGTGPC
NNVSTVQCTHGIKPVVSTQLLLNGSLAEGEIIIRSENITDNSKTIIVHLNESVKIECTRP
SNNTRTSIRIGPGQWFYATGQVIGDIREAHCNISESKWNETLQRVSKKLKEYFPDKNITF
QPSSGGDPEITTHSFNCGGEFFYCNTSSLFNRTYMANSTETNSTRTITLHCRIKQIINMW
QEVGRAMYAPPIAGNITCISNITGLLLTRDGGENTRDGGNNNTETFRPEGGNMKDNWRSE
LYKYKVVKIEPLGVAPTRCKRRVVGRRRRRRAVGIGAVFLGFLGAAGSTMGAASMTLTVQ
ARNLLSGIVQQQSNLLRAPEAQQHLLKLTVWGIKQLQARVLAVERYLRDQQLLGIWGCSG
KLICCTNVPWNSSWSNRNLSEIWDNMTWLQWDKEISNYTQIIYGLLEESQNQQEKNEQDL
LALD*

>HV1301301, CH505w100.B6chim.6R.SOSIP.664v4.2 (SEQ ID NO. 251)
MPMGSLQPLATLYLLGMLVASVLAAENLWVTVYYGVPVWKEAKTTLFCASDAKAYEKEVR
NVWATHACVPTDPNPQEMVLENVTENFNMWKNDMADQMHEDVISLWDQSLKPCVKLTPLC
VTLNCTDANATASNTNATASNINATASKSSIIEEMKNCSFNITTELRDKREKKYALFYKL
DIVQLDGNSSQYRLINCNTSVITQACPKVSFDPIPIHYCAPAGYAILKCNNKTFNGTGPC
NNVSTVQCTHGIKPVVSTQLLLNGSLAEGEIIIRSENITDNSKTIIVHLNESVKIECTRP
SNNTRTSIRIGPGQWFYATGQVIGDIREAHCNISESKWNETLQRVSKKLKEYFPDKNITF
QPSSGGDPEITTHSFNCGGEFFYCNTSSLFNRTYMANSTETNSTRTITLHCRIKQIINMW
QEVGRAMYAPPIAGNITCISNITGLLLTRDGGENTRDGGNNNTETFRPEGGNMKDNWRSE
LYKYKVVKIEPLGVAPTRCKRRVVGRRRRRRAVGIGAVFLGFLGAAGSTMGAASMTLTVQ
ARNLLSGIVQQQSNLLRAPEAQQHLLKLTVWGIKQLQARVLAVERYLRDQQLLGIWGCSG
KLICCTNVPWNSSWSNRNLSEIWDNMTWLQWDKEISNYTQIIYGLLEESQNQQEKNEQDL
LALD*

>HV1301293, CH505w136.B18chim.6R.SOSIP.664v4.1 (SEQ ID NO. 252)
MPMGSLQPLATLYLLGMLVASVLAAENLWVTVYYGVPVWKEAKTTLFCASDAKAYEKKVH
NVWATHACVPTDPNPQEMVLKNVTENFNMWKNDMVDQMHEDVISLWDQSLTPCVKLTPLC
VTLNCTDANDTASNSSIIKGMNNSIVGEMKNCSFNITTELRDKREKKNALFYKLDIVQLD
GNSSEYRLINCNTSVITQACPKVSFDPIPIHYCAPAGYAILKCNNKTFNGTGPCNNVSTV
QCTHGIKPVVSTQLLLNGSLAEGEIIIRSENITDNAKTIIVHLNESVKIECTRPSNNTRT
SIRIGPGQWFYATGQVIGDIRKAHCNISESKWNETLQRVSKKLKEYFPDKNITFQPSSGG
DPEITTHSFNCGGEFFYCNTSSLFNRTYMANSTDMANSAETNSTRTITLHCRIKQIINMW
QEVGRAMYAPPIAGNITCISNITGLLLTRDGGNSSTETETFRPGGGNMKDNWRSELYKYK
VVKIEPLGVAPTRCKRRVVGRRRRRRAVGIGAVFLGFLGAAGSTMGAASMTLTVQARNLL
SGIVQQQSNLLRAPEAQQHLLKLTVWGIKQLQARVLAVERYLRDQQLLGIWGCSGKLICC
TNVPWNSSWSNRNLSEIWDNMTWLQWDKEISNYTQIIYGLLEESQNQQEKNEQDLLALD*

>HV1301302, CH505w136.B18chim.6R.SOSIP.664v4.2 (SEQ ID NO. 253)
MPMGSLQPLATLYLLGMLVASVLAAENLWVTVYYGVPVWKEAKTTLFCASDAKAYEKEVR
NVWATHACVPTDPNPQEMVLKNVTENFNMWKNDMVDQMHEDVISLWDQSLTPCVKLTPLC
VTLNCTDANDTASNSSIIKGMNNSIVGEMKNCSFNITTELRDKREKKNALFYKLDIVQLD
GNSSEYRLINCNTSVITQACPKVSFDPIPIHYCAPAGYAILKCNNKTFNGTGPCNNVSTV
QCTHGIKPVVSTQLLLNGSLAEGEIIIRSENITDNAKTIIVHLNESVKIECTRPSNNTRT
SIRIGPGQWFYATGQVIGDIRKAHCNISESKWNETLQRVSKKLKEYFPDKNITFQPSSGG
DPEITTHSFNCGGEFFYCNTSSLFNRTYMANSTDMANSAETNSTRTITLHCRIKQIINMW
QEVGRAMYAPPIAGNITCISNITGLLLTRDGGNSSTETETFRPGGGNMKDNWRSELYKYK
VVKIEPLGVAPTRCKRRVVGRRRRRRAVGIGAVFLGFLGAAGSTMGAASMTLTVQARNLL

Figure 23A cont.

SGIVQQQSNLLRAPEAQQHLLKLTVWGIKQLQARVLAVERYLRDQQLLGIWGCSGKLICC
TNVPWNSSWSNRNLSEIWDNMTWLQWDKEISNYTQIIYGLLEESQNQQEKNEQDLLALD*

>HV1301294, CH505w20.14chim.6R.SOSIP.664v4.1 (SEQ ID NO. 254)
MPMGSLQPLATLYLLGMLVASVLAAENLWVTVYYGVPVWKEAKTTLFCASDAKAYEKKVH
NVWATHACVPTDPNPQEMVLKNVTENFNMWKNDMVDQMHEDVISLWDQSLKPCVKLTPLC
VTLNCTNATASNNSIIEGMKNCSFNITTELRDKREKKNALFYKLDIVQLDGNSSQYRLIN
CNTSVITQACPKVSFDPIPIHYCAPAGYAILKCNNKTFTGTGPCNNVSTVQCTHGIKPVV
STQLLLNGSLAEGEIIIRSENITNNAKTIIVHLNESVKIECTRPNNKTRTSIRIGPGQWF
YATGQVIGDIRKAYCNISESKWNETLQRVSKKLKEYFPHKNITFQPSSGGDLEITTHSFN
CGGEFFYCNTSSLFNRTYMANSTDMANSTETNSTRTITLHCRIKQIINMWQEVGRAMYAP
PIAGNITCISNITGLLLTRDGGKNNTETFRPGGGNMKDNWRSELYKYKVVKIEPLGVAPT
RCKRRVVGRRRRRRAVGIGAVFLGFLGAAGSTMGAASMTLTVQARNLLSGIVQQQSNLLR
APEAQQHLLKLTVWGIKQLQARVLAVERYLRDQQLLGIWGCSGKLICCTNVPWNSSWSNR
NLSEIWDNMTWLQWDKEISNYTQIIYGLLEESQNQQEKNEQDLLALD*

>HV1301303, CH505w20.14chim.6R.SOSIP.664v4.2 (SEQ ID NO. 255)
MPMGSLQPLATLYLLGMLVASVLAAENLWVTVYYGVPVWKEAKTTLFCASDAKAYEKEVR
NVWATHACVPTDPNPQEMVLKNVTENFNMWKNDMVDQMHEDVISLWDQSLKPCVKLTPLC
VTLNCTNATASNNSIIEGMKNCSFNITTELRDKREKKNALFYKLDIVQLDGNSSQYRLIN
CNTSVITQACPKVSFDPIPIHYCAPAGYAILKCNNKTFTGTGPCNNVSTVQCTHGIKPVV
STQLLLNGSLAEGEIIIRSENITNNAKTIIVHLNESVKIECTRPNNKTRTSIRIGPGQWF
YATGQVIGDIRKAYCNISESKWNETLQRVSKKLKEYFPHKNITFQPSSGGDLEITTHSFN
CGGEFFYCNTSSLFNRTYMANSTDMANSTETNSTRTITLHCRIKQIINMWQEVGRAMYAP
PIAGNITCISNITGLLLTRDGGKNNTETFRPGGGNMKDNWRSELYKYKVVKIEPLGVAPT
RCKRRVVGRRRRRRAVGIGAVFLGFLGAAGSTMGAASMTLTVQARNLLSGIVQQQSNLLR
APEAQQHLLKLTVWGIKQLQARVLAVERYLRDQQLLGIWGCSGKLICCTNVPWNSSWSNR
NLSEIWDNMTWLQWDKEISNYTQIIYGLLEESQNQQEKNEQDLLALD*

>HV1301295, CH505w30.12chim.6R.SOSIP.664v4.1 (SEQ ID NO. 256)
MPMGSLQPLATLYLLGMLVASVLAAENLWVTVYYGVPVWKEAKTTLFCASDAKAYEKKVH
NVWATHACVPTDPNPQEMVLKNVTENFNMWKNDMVDQMHEDVISLWDQSLKPCVKLTPLC
VTLNCTNATNATASNSSIIEGMKNCSFNITTELRDKREKKNALFYKLDIVQLDGNSSQYR
LINCNTSVITQACPKVSFDPIPIHYCAPAGYAILKCNNKTFTGTGPCNNVSTVQCTHGIK
PVVSTQLLLNGSLAEGEIIIRSENITNNDKTIIVHLNESVKIECTRPSNKTRTSIRIGPG
QWFYATGQVIGDIREAYCNISESKWNETLQRVSKKLKEYFPHKNITFQPSSGGDLEITTH
SFNCGGEFFYCNTSSLFNRTYMANSTDMANSTETNSTRNITIHCRIKQIINMWQEVGRAM
YAPPIAGNITCISNITGLLLTRDGGKNDTETFRPGGGNMKDNWRSELYKYKVVKIEPLGV
APTRCKRRVVGRRRRRRAVGIGAVFLGFLGAAGSTMGAASMTLTVQARNLLSGIVQQQSN
LLRAPEAQQHLLKLTVWGIKQLQARVLAVERYLRDQQLLGIWGCSGKLICCTNVPWNSSW
SNRNLSEIWDNMTWLQWDKEISNYTQIIYGLLEESQNQQEKNEQDLLALD*

>HV1301304, CH505w30.12chim.6R.SOSIP.664v4.2 (SEQ ID NO. 257)
MPMGSLQPLATLYLLGMLVASVLAAENLWVTVYYGVPVWKEAKTTLFCASDAKAYEKEVR
NVWATHACVPTDPNPQEMVLKNVTENFNMWKNDMVDQMHEDVISLWDQSLKPCVKLTPLC
VTLNCTNATNATASNSSIIEGMKNCSFNITTELRDKREKKNALFYKLDIVQLDGNSSQYR
LINCNTSVITQACPKVSFDPIPIHYCAPAGYAILKCNNKTFTGTGPCNNVSTVQCTHGIK
PVVSTQLLLNGSLAEGEIIIRSENITNNDKTIIVHLNESVKIECTRPSNKTRTSIRIGPG
QWFYATGQVIGDIREAYCNISESKWNETLQRVSKKLKEYFPHKNITFQPSSGGDLEITTH
SFNCGGEFFYCNTSSLFNRTYMANSTDMANSTETNSTRNITIHCRIKQIINMWQEVGRAM
YAPPIAGNITCISNITGLLLTRDGGKNDTETFRPGGGNMKDNWRSELYKYKVVKIEPLGV
APTRCKRRVVGRRRRRRAVGIGAVFLGFLGAAGSTMGAASMTLTVQARNLLSGIVQQQSN
LLRAPEAQQHLLKLTVWGIKQLQARVLAVERYLRDQQLLGIWGCSGKLICCTNVPWNSSW
SNRNLSEIWDNMTWLQWDKEISNYTQIIYGLLEESQNQQEKNEQDLLALD*

Figure 23A cont.

>HV1301296, CH505w30.20.chim.6R.SOSIP.664v4.1 (SEQ ID NO. 258)
MPMGSLQPLATLYLLGMLVASVLAAENLWVTVYYGVPVWKEAKTTLFCASDAKAYEKKVH
NVWATHACVPTDPNPQEMVLKNVTENFNMWKNDMVDQMHEDVISLWDQSLKPCVKLTPLC
VTLNCTNATTNATASNSSIIEGMKNCSFNITTELRDKREKKNALFYKLDIVQLDGNSSQY
RLINCNTSVITQACPKVSFDPIPIHYCAPAGYAILKCNNKTFTGTGPCNNVSTVQCTHGI
KPVVSTQLLLNGSLAEGEIIIRSENITNNAKTIIVHLNESVKIECTRPNNKTRTSIRIGP
GQWFYATGQVIGDIREAYCNISESKWNETLQRVSKKLKEYFPHKNITFQPSSGGDLEITT
HSFNCGGEFFYCNTSSLFNRTYMANSTDMANSTETNSTRIITIHCRIKQIINMWQEVGRA
MYAPPIAGNITCISNITGLLLTRDGGKNTRDGGKNNTETFRPGGGNMKDNWRSELYKYKV
VKIEPLGVAPTRCKRRVVGRRRRRRAVGIGAVFLGFLGAAGSTMGAASMTLTVQARNLLS
GIVQQQSNLLRAPEAQQHLLKLTVWGIKQLQARVLAVERYLRDQQLLGIWGCSGKLICCT
NVPWNSSWSNRNLSEIWDNMTWLQWDKEISNYTQIIYGLLEESQNQQEKNEQDLLALD*

>HV1301305, CH505w30.20chim.6R.SOSIP.664v4.2 (SEQ ID NO. 259)
MPMGSLQPLATLYLLGMLVASVLAAENLWVTVYYGVPVWKEAKTTLFCASDAKAYEKEVR
NVWATHACVPTDPNPQEMVLKNVTENFNMWKNDMVDQMHEDVISLWDQSLKPCVKLTPLC
VTLNCTNATTNATASNSSIIEGMKNCSFNITTELRDKREKKNALFYKLDIVQLDGNSSQY
RLINCNTSVITQACPKVSFDPIPIHYCAPAGYAILKCNNKTFTGTGPCNNVSTVQCTHGI
KPVVSTQLLLNGSLAEGEIIIRSENITNNAKTIIVHLNESVKIECTRPNNKTRTSIRIGP
GQWFYATGQVIGDIREAYCNISESKWNETLQRVSKKLKEYFPHKNITFQPSSGGDLEITT
HSFNCGGEFFYCNTSSLFNRTYMANSTDMANSTETNSTRIITIHCRIKQIINMWQEVGRA
MYAPPIAGNITCISNITGLLLTRDGGKNTRDGGKNNTETFRPGGGNMKDNWRSELYKYKV
VKIEPLGVAPTRCKRRVVGRRRRRRAVGIGAVFLGFLGAAGSTMGAASMTLTVQARNLLS
GIVQQQSNLLRAPEAQQHLLKLTVWGIKQLQARVLAVERYLRDQQLLGIWGCSGKLICCT
NVPWNSSWSNRNLSEIWDNMTWLQWDKEISNYTQIIYGLLEESQNQQEKNEQDLLALD*

>HV1301189, CH505TFchim.6R.SOSIP.664v4.1 (SEQ ID NO. 260)
MPMGSLQPLATLYLLGMLVASVLAAENLWVTVYYGVPVWKEAKTTLFCASDAKAYEKKVHNVWATHACVPTDPNPQEMVL
KNVTENFNMWKNDMVDQMHEDVISLWDQSLKPCVKLTPLCVTLNCTNATASNSSIIEGMKNCSFNITTELRDKREKKNAL
FYKLDIVQLDGNSSQYRLINCNTSVITQACPKVSFDPIPIHYCAPAGYAILKCNNKTFTGTGPCNNVSTVQCTHGIKPVV
STQLLLNGSLAEGEIIIRSENITNNVKTIIVHLNESVKIECTRPNNKTRTSIRIGPGQWFYATGQVIGDIREAYCNINES
KWNETLQRVSKKLKEYFPHKNITFQPSSGGDLEITTHSFNCGGEFFYCNTSSLFNRTYMANSTDMANSTETNSTRTITIH
CRIKQIINMWQEVGRAMYAPPIAGNITCISNITGLLLTRDGGKNNTETFRPGGGNMKDNWRSELYKYKVVKIEPLGVAPT
RCKRRVVGRRRRRRAVGIGAVFLGFLGAAGSTMGAASMTLTVQARNLLSGIVQQQSNLLRAPEAQQHLLKLTVWGIKQLQ
ARVLAVERYLRDQQLLGIWGCSGKLICCTNVPWNSSWSNRNLSEIWDNMTWLQWDKEISNYTQIIYGLLEESQNQQEKNE
QDLLALD**

>HV1301190, CH505TFchim.6R.SOSIP.664v4.2 (SEQ ID NO. 261)
MPMGSLQPLATLYLLGMLVASVLAAENLWVTVYYGVPVWKEAKTTLFCASDAKAYEKEVRNVWATHACVPTDPNPQEMVL
KNVTENFNMWKNDMVDQMHEDVISLWDQSLKPCVKLTPLCVTLNCTNATASNSSIIEGMKNCSFNITTELRDKREKKNAL
FYKLDIVQLDGNSSQYRLINCNTSVITQACPKVSFDPIPIHYCAPAGYAILKCNNKTFTGTGPCNNVSTVQCTHGIKPVV
STQLLLNGSLAEGEIIIRSENITNNVKTIIVHLNESVKIECTRPNNKTRTSIRIGPGQWFYATGQVIGDIREAYCNINES
KWNETLQRVSKKLKEYFPHKNITFQPSSGGDLEITTHSFNCGGEFFYCNTSSLFNRTYMANSTDMANSTETNSTRTITIH
CRIKQIINMWQEVGRAMYAPPIAGNITCISNITGLLLTRDGGKNNTETFRPGGGNMKDNWRSELYKYKVVKIEPLGVAPT
RCKRRVVGRRRRRRAVGIGAVFLGFLGAAGSTMGAASMTLTVQARNLLSGIVQQQSNLLRAPEAQQHLLKLTVWGIKQLQ
ARVLAVERYLRDQQLLGIWGCSGKLICCTNVPWNSSWSNRNLSEIWDNMTWLQWDKEISNYTQIIYGLLEESQNQQEKNE
QDLLALD*

Figure 23A cont.

>CH505w030.25chim.6R.SOSIP.664 (SEQ ID NO. 262)
MGSLQPLATLYLLGMLVASVLAAENLWVTVYYGVPVWKEAKTTLFCASDAKAYEKEVHNVWATHACVPTDPNPQEMVL
KNVTENFNMWKNDMVDQMHEDVISLWDQSLKPCVKLTPLCVTLNCTNATTNATASNSSIIEGMKNCSFNITTELRDKRE
KKNALFYKLDIVQLDGNSSQYRLINCNTSVITQACPKVSFDPIPIHYCAPAGYAILKCNNKTFTGTGPCNNVSTVQCTHGIKP
VVSTQLLLNGSLAEGEIIIRSENITNNAKTIIVHLNESVKIECTRPNNKTRTSIRIGPGQAFYATGQVIGDIREAHCNISESKWNE
TLQRVSKKLKEYFPHKNITFQPSSGGDLEITTHSFNCGGEFFYCNTSSLFNRTYMANSTDMANSTETNSTRTITIRCRIKQIIN
MWQEVGRAMYAPPIAGNITCISNITGLLLTRDGGKNNTDTETFRPGGGNMKDNWRSELYKYKVVKIEPLGVAPTRCKRR
VVGRRRRRRAVGIGAVFLGFLGAAGSTMGAASMTLTVQARNLLSGIVQQQSNLLRAPEAQQHLLKLTVWGIKQLQARVL
AVERYLRDQQLLGIWGCSGKLICCTNVPWNSSWSNRNLSEIWDNMTWLQWDKEISNYTQIIYGLLEESQNQQEKNEQDL
LALD*

>CH505w030.25chim.DS.6R.SOSIP.664 (SEQ ID NO. 263)
MGSLQPLATLYLLGMLVASVLAAENLWVTVYYGVPVWKEAKTTLFCASDAKAYEKEVHNVWATHACVPTDPNPQEMVL
KNVTENFNMWKNDMVDQMHEDVISLWDQSLKPCVKLTPLCVTLNCTNATTNATASNSSIIEGMKNCSFNITTELRDKRE
KKNALFYKLDIVQLDGNSSQYRLINCNTSVCTQACPKVSFDPIPIHYCAPAGYAILKCNNKTFTGTGPCNNVSTVQCTHGIKP
VVSTQLLLNGSLAEGEIIIRSENITNNAKTIIVHLNESVKIECTRPNNKTRTSIRIGPGQAFYATGQVIGDIREAHCNISESKWNE
TLQRVSKKLKEYFPHKNITFQPSSGGDLEITTHSFNCGGEFFYCNTSSLFNRTYMANSTDMANSTETNSTRTITIRCRIKQIIN
MWQEVGRCMYAPPIAGNITCISNITGLLLTRDGGKNNTDTETFRPGGGNMKDNWRSELYKYKVVKIEPLGVAPTRCKRR
VVGRRRRRRAVGIGAVFLGFLGAAGSTMGAASMTLTVQARNLLSGIVQQQSNLLRAPEAQQHLLKLTVWGIKQLQARVL
AVERYLRDQQLLGIWGCSGKLICCTNVPWNSSWSNRNLSEIWDNMTWLQWDKEISNYTQIIYGLLEESQNQQEKNEQDL
LALD*

>CH505w030.25chim.6R.SOSIP.664v4.1 (SEQ ID NO. 264)
MGSLQPLATLYLLGMLVASVLAAENLWVTVYYGVPVWKEAKTTLFCASDAKAYEKKVHNVWATHACVPTDPNPQEMVL
KNVTENFNMWKNDMVDQMHEDVISLWDQSLKPCVKLTPLCVTLNCTNATTNATASNSSIIEGMKNCSFNITTELRDKRE
KKNALFYKLDIVQLDGNSSQYRLINCNTSVITQACPKVSFDPIPIHYCAPAGYAILKCNNKTFTGTGPCNNVSTVQCTHGIKP
VVSTQLLLNGSLAEGEIIIRSENITNNAKTIIVHLNESVKIECTRPNNKTRTSIRIGPGQWFYATGQVIGDIREAHCNISESKWN
ETLQRVSKKLKEYFPHKNITFQPSSGGDLEITTHSFNCGGEFFYCNTSSLFNRTYMANSTDMANSTETNSTRTITIRCRIKQII
NMWQEVGRAMYAPPIAGNITCISNITGLLLTRDGGKNNTDTETFRPGGGNMKDNWRSELYKYKVVKIEPLGVAPTRCKR
RVVGRRRRRRAVGIGAVFLGFLGAAGSTMGAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQWDKEISNYTQIIYGLLEESQNQQEKNEQD
LLALD*

>CH505w030.25chim.6R.SOSIP.664v4.2 (SEQ ID NO. 265)
MGSLQPLATLYLLGMLVASVLAAENLWVTVYYGVPVWKEAKTTLFCASDAKAYEKEVRNVWATHACVPTDPNPQEMVL
KNVTENFNMWKNDMVDQMHEDVISLWDQSLKPCVKLTPLCVTLNCTNATTNATASNSSIIEGMKNCSFNITTELRDKRE
KKNALFYKLDIVQLDGNSSQYRLINCNTSVITQACPKVSFDPIPIHYCAPAGYAILKCNNKTFTGTGPCNNVSTVQCTHGIKP
VVSTQLLLNGSLAEGEIIIRSENITNNAKTIIVHLNESVKIECTRPNNKTRTSIRIGPGQWFYATGQVIGDIREAHCNISESKWN
ETLQRVSKKLKEYFPHKNITFQPSSGGDLEITTHSFNCGGEFFYCNTSSLFNRTYMANSTDMANSTETNSTRTITIRCRIKQII
NMWQEVGRAMYAPPIAGNITCISNITGLLLTRDGGKNNTDTETFRPGGGNMKDNWRSELYKYKVVKIEPLGVAPTRCKR
RVVGRRRRRRAVGIGAVFLGFLGAAGSTMGAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQWDKEISNYTQIIYGLLEESQNQQEKNEQD
LLALD*

Figure 23A cont.

>CH505w053.25chim.6R.SOSIP.664 (SEQ ID NO. 266)
MGSLQPLATLYLLGMLVASVLAAENLWVTVYYGVPVWKEAKTTLFCASDAKAYEKEVHNVWATHACVPTDPNPQEMVL
KNVTENFNMWENDMVDQMHEDVISLWDQSLKPCVKLTPLCVTLNCTDATASNATASNATASNSSIIEGMKNCSFNITTE
LRDKREKKNALFYKLDIVQLDGNSSQYRLINCNTSVITQACPKVSFDPIPIHYCAPAGYAILKCNNKTFNGTGPCNNVSTVQC
THGIKPVVSTQLLLNGSLAEGEIIIRSENITDNGKTIIVHLNESVKIECTRPSNNTRTSIRIGPGQAFYATGQVIGDIREAHCNISE
NKWNETLQRVSKKLKEYFPHKNITFQPSSGGDLEITTHSFNCGGEFFYCNTSSLFNRTYMANSTDMANSTETNSTRTITIRC
RIKQIINMWQEVGRAMYAPPIAGNITCISNITGLLLTRDGGKNNTETFETFRPGGGNMKDNWRSELYKYKVVKIEPLGVAP
TRCKRRVVGRRRRRRAVGIGAVFLGFLGAAGSTMGAASMTLTVQARNLLSGIVQQQSNLLRAPEAQQHLLKLTVWGIKQ
LQARVLAVERYLRDQQLLGIWGCSGKLICCTNVPWNSSWSNRNLSEIWDNMTWLQWDKEISNYTQIIYGLLEESQNQQE
KNEQDLLALD*

>CH505w053.25chim.DS.6R.SOSIP.664 (SEQ ID NO. 267)
MGSLQPLATLYLLGMLVASVLAAENLWVTVYYGVPVWKEAKTTLFCASDAKAYEKEVHNVWATHACVPTDPNPQEMVL
KNVTENFNMWENDMVDQMHEDVISLWDQSLKPCVKLTPLCVTLNCTDATASNATASNATASNSSIIEGMKNCSFNITTE
LRDKREKKNALFYKLDIVQLDGNSSQYRLINCNTSVCTQACPKVSFDPIPIHYCAPAGYAILKCNNKTFNGTGPCNNVSTVQ
CTHGIKPVVSTQLLLNGSLAEGEIIIRSENITDNGKTIIVHLNESVKIECTRPSNNTRTSIRIGPGQAFYATGQVIGDIREAHCNIS
ENKWNETLQRVSKKLKEYFPHKNITFQPSSGGDLEITTHSFNCGGEFFYCNTSSLFNRTYMANSTDMANSTETNSTRTITIR
CRIKQIINMWQEVGRCMYAPPIAGNITCISNITGLLLTRDGGKNNTETFETFRPGGGNMKDNWRSELYKYKVVKIEPLGVA
PTRCKRRVVGRRRRRRAVGIGAVFLGFLGAAGSTMGAASMTLTVQARNLLSGIVQQQSNLLRAPEAQQHLLKLTVWGIK
QLQARVLAVERYLRDQQLLGIWGCSGKLICCTNVPWNSSWSNRNLSEIWDNMTWLQWDKEISNYTQIIYGLLEESQNQQ
EKNEQDLLALD*

> CH505w053.25chim.6R.SOSIP.664v4.1 (SEQ ID NO. 268)
MGSLQPLATLYLLGMLVASVLAAENLWVTVYYGVPVWKEAKTTLFCASDAKAYEKKVHNVWATHACVPTDPNPQEMVL
KNVTENFNMWENDMVDQMHEDVISLWDQSLKPCVKLTPLCVTLNCTDATASNATASNATASNSSIIEGMKNCSFNITTE
LRDKREKKNALFYKLDIVQLDGNSSQYRLINCNTSVITQACPKVSFDPIPIHYCAPAGYAILKCNNKTFNGTGPCNNVSTVQC
THGIKPVVSTQLLLNGSLAEGEIIIRSENITDNGKTIIVHLNESVKIECTRPSNNTRTSIRIGPGQWFYATGQVIGDIREAHCNIS
ENKWNETLQRVSKKLKEYFPHKNITFQPSSGGDLEITTHSFNCGGEFFYCNTSSLFNRTYMANSTDMANSTETNSTRTITIR
CRIKQIINMWQEVGRAMYAPPIAGNITCISNITGLLLTRDGGKNNTETFETFRPGGGNMKDNWRSELYKYKVVKIEPLGVA
PTRCKRRVVGRRRRRRAVGIGAVFLGFLGAAGSTMGAASMTLTVQARNLLSGIVQQQSNLLRAPEAQQHLLKLTVWGIK
QLQARVLAVERYLRDQQLLGIWGCSGKLICCTNVPWNSSWSNRNLSEIWDNMTWLQWDKEISNYTQIIYGLLEESQNQQ
EKNEQDLLALD > CH505w053.25chim.6R.SOSIP.664v4.2 (SEQ ID NO. 269)
MGSLQPLATLYLLGMLVASVLAAENLWVTVYYGVPVWKEAKTTLFCASDAKAYEKEVRNVWATHACVPTDPNPQEMVL
KNVTENFNMWENDMVDQMHEDVISLWDQSLKPCVKLTPLCVTLNCTDATASNATASNATASNSSIIEGMKNCSFNITTE
LRDKREKKNALFYKLDIVQLDGNSSQYRLINCNTSVITQACPKVSFDPIPIHYCAPAGYAILKCNNKTFNGTGPCNNVSTVQC
THGIKPVVSTQLLLNGSLAEGEIIIRSENITDNGKTIIVHLNESVKIECTRPSNNTRTSIRIGPGQWFYATGQVIGDIREAHCNIS
ENKWNETLQRVSKKLKEYFPHKNITFQPSSGGDLEITTHSFNCGGEFFYCNTSSLFNRTYMANSTDMANSTETNSTRTITIR
CRIKQIINMWQEVGRAMYAPPIAGNITCISNITGLLLTRDGGKNNTETFETFRPGGGNMKDNWRSELYKYKVVKIEPLGVA
PTRCKRRVVGRRRRRRAVGIGAVFLGFLGAAGSTMGAASMTLTVQARNLLSGIVQQQSNLLRAPEAQQHLLKLTVWGIK
QLQARVLAVERYLRDQQLLGIWGCSGKLICCTNVPWNSSWSNRNLSEIWDNMTWLQWDKEISNYTQIIYGLLEESQNQQ
EKNEQDLLALD*

Figure 23A cont.

>CH505w053.29chim.6R.SOSIP.664 (SEQ ID NO. 270)
MGSLQPLATLYLLGMLVASVLAAENLWVTVYYGVPVWKEAKTTLFCASDAKAYEKEVHNVWATHACVPTDPNPQEMVL
KNVTENFNMWKNDMVDQMHEDVISLWDQSLKPCVKLTPLCVTLNCTDATASNATAINSSIIEGMKNCSFNITTELRDKRE
KKNALFYKLDIVQLDGNSSQYRLINCNTSVITQACPKVSFDPIPIHYCAPAGYAILKCNNKTFNGTGPCNNVSTVQCTHGIKP
VVSTQLLLNGSLAEGEIIIRSENITNNAKTIIVHLNESVKIECTRPSNNTRTSIRIGPGQAFYATGQVIGDIREAHCNISESKWNE
TLQRVSKKLKEYFPHKNITFQPSSGGDLEITTHSFNCGGEFFYCNTSSLFNRTYMANSTETNSTRIITIRCRIKQIINMWQEVG
RAMYAPPIAGNITCISNITGLLLTRDGGKNNTETFETFRPEGGNMKDNWRSELYKYKVVKIEPLGVAPTRCKRRVVGRRRR
RRAVGIGAVFLGFLGAAGSTMGAASMTLTVQARNLLSGIVQQQSNLLRAPEAQQHLLKLTVWGIKQLQARVLAVERYLRD
QQLLGIWGCSGKLICCTNVPWNSSWSNRNLSEIWDNMTWLQWDKEISNYTQIIYGLLEESQNQQEKNEQDLLALD*

>CH505w053.29chim.6R.SOSIP.664v4.1 (SEQ ID NO. 271)
MGSLQPLATLYLLGMLVASVLAAENLWVTVYYGVPVWKEAKTTLFCASDAKAYEKKVHNVWATHACVPTDPNPQEMVL
KNVTENFNMWKNDMVDQMHEDVISLWDQSLKPCVKLTPLCVTLNCTDATASNATAINSSIIEGMKNCSFNITTELRDKRE
KKNALFYKLDIVQLDGNSSQYRLINCNTSVITQACPKVSFDPIPIHYCAPAGYAILKCNNKTFNGTGPCNNVSTVQCTHGIKP
VVSTQLLLNGSLAEGEIIIRSENITNNAKTIIVHLNESVKIECTRPSNNTRTSIRIGPGQWFYATGQVIGDIREAHCNISESKWN
ETLQRVSKKLKEYFPHKNITFQPSSGGDLEITTHSFNCGGEFFYCNTSSLFNRTYMANSTETNSTRIITIRCRIKQIINMWQEV
GRAMYAPPIAGNITCISNITGLLLTRDGGKNNTETFETFRPEGGNMKDNWRSELYKYKVVKIEPLGVAPTRCKRRVVGRRR
RRRAVGIGAVFLGFLGAAGSTMGAASMTLTVQARNLLSGIVQQQSNLLRAPEAQQHLLKLTVWGIKQLQARVLAVERYLR
DQQLLGIWGCSGKLICCTNVPWNSSWSNRNLSEIWDNMTWLQWDKEISNYTQIIYGLLEESQNQQEKNEQDLLALD*

>CH505w053.29chim.6R.SOSIP.664v4.2 (SEQ ID NO. 272)
MGSLQPLATLYLLGMLVASVLAAENLWVTVYYGVPVWKEAKTTLFCASDAKAYEKEVRNVWATHACVPTDPNPQEMVL
KNVTENFNMWKNDMVDQMHEDVISLWDQSLKPCVKLTPLCVTLNCTDATASNATAINSSIIEGMKNCSFNITTELRDKRE
KKNALFYKLDIVQLDGNSSQYRLINCNTSVITQACPKVSFDPIPIHYCAPAGYAILKCNNKTFNGTGPCNNVSTVQCTHGIKP
VVSTQLLLNGSLAEGEIIIRSENITNNAKTIIVHLNESVKIECTRPSNNTRTSIRIGPGQWFYATGQVIGDIREAHCNISESKWN
ETLQRVSKKLKEYFPHKNITFQPSSGGDLEITTHSFNCGGEFFYCNTSSLFNRTYMANSTETNSTRIITIRCRIKQIINMWQEV
GRAMYAPPIAGNITCISNITGLLLTRDGGKNNTETFETFRPEGGNMKDNWRSELYKYKVVKIEPLGVAPTRCKRRVVGRRR
RRRAVGIGAVFLGFLGAAGSTMGAASMTLTVQARNLLSGIVQQQSNLLRAPEAQQHLLKLTVWGIKQLQARVLAVERYLR
DQQLLGIWGCSGKLICCTNVPWNSSWSNRNLSEIWDNMTWLQWDKEISNYTQIIYGLLEESQNQQEKNEQDLLALD*

Figure 23A cont.

CH505TF chimera SOSIP.664.v4.1 (SOSIP.III) annotated

*Human CD5 leader sequence: MPMGSLQPLATLYLLGMLVASVLA* (SEQ ID NO. 273);
Amino acids from strain BG505;
Start of gp41 from BG505
Sequence between right and left arrows is from CH505 except for the v4.1 mutations
V4.1 mutation shows the position of the lysine mutation correspondnng to E64K and the position of the A316W mutation (See de Taeye et al. (2015) Cell 163, 1702-1715.

| | | 1 *CD5 Leader* CH505 sequence 50 |
|---|---|---|
| CH505TF chimera SOSIP.664.v4.1 (SEQ ID NO. 274) | (1) | -MPMGSLQPLATLYLLGMLVASVLAAEN-LWVTVYYGVPVWKEAKTTLFC |
| HV1301003 CH505 TF gp160 (SEQ ID NO. 275) | (1) | MRVMGIQRNYPQWWIWSMLGFWMLMICNGMWVTVYYGVPVWKEAKTTLFC |
| VRC4112 BG505 SOSIP (SEQ ID NO. 276) | (1) | ---------------------------AEN-LWVTVYYGVPVWKDAETTLFC |
| Consensus | (1) | MG WI ML ML AEN LWVTVYYGVPVWKEAKTTLFC |
| | | 51 v4.1 mutation 100 |
| CH505TF chimera SOSIP.664.v4.1 | (49) | ASDAKAYEKKVHNVWATHACVPTDPNPQEMVLKNVTENFNMWKNDMVDQM |
| HV1301003 CH505 TF gp160 | (51) | ASDAKAYEKEVHNVWATHACVPTDPNPQEMVLKNVTENFNMWKNDMVDQM |
| VRC4112 BG505 SOSIP | (25) | ASDAKAYETEKHNVWATHACVPTDPNPQEIHLENVTEEFNMWKNNMVEQM |
| Consensus | (51) | ASDAKAYEKEVHNVWATHACVPTDPNPQEMVLKNVTENFNMWKNDMVDQM |
| | | 101 150 |
| CH505TF chimera SOSIP.664.v4.1 | (99) | HEDVISLWDQSLKPCVKLTPLCVTLNCTNATASNSSIIEG-MKNCSFNIT |
| HV1301003 CH505 TF gp160 | (101) | HEDVISLWDQSLKPCVKLTPLCVTLNCTNATASNSSIIEG-MKNCSFNIT |
| VRC4112 BG505 SOSIP | (75) | HTDIISLWDQSLKPCVKLTPLCVTLQCTNVTNNITDDMRGELKNCSFNMT |
| Consensus | (101) | HEDVISLWDQSLKPCVKLTPLCVTLNCTNATASNSSIIEG MKNCSFNIT |
| | | 151 200 |
| CH505TF chimera SOSIP.664.v4.1 | (148) | TELRDKREKKNALFYKLDIVQLDGN---------SSQYRLINCNTSVITQA |
| HV1301003 CH505 TF gp160 | (150) | TELRDKREKKNALFYKLDIVQLDGN---------SSQYRLINCNTSVITQA |
| VRC4112 BG505 SOSIP | (125) | TELRDKKQKVYSLFYRLDVVQINENQGNRSNNSNKEYRLINCNTSAITQA |
| Consensus | (151) | TELRDKREKKNALFYKLDIVQLDGN SSQYRLINCNTSVITQA |

Figure 23B

```
                                      201                                               250
CH505TF chimera SOSIP.664.v4.1  (190) CPKVSFDPIPIHYCAPAGYAILKCNNKTFTGTGPCNNVSTVQCTHGIKPV
    HV1301003 CH505 TF gp160    (192) CPKVSFDPIPIHYCAPAGYAILKCNNKTFTGTGPCNNVSTVQCTHGIKPV
          VRC4112 BG505 SOSIP   (175) CPKVSFEPIPIHYCAPAGFAILKCKDKKFNGTGPCPSVSTVQCTHGIKPV
                    Consensus   (201) CPKVSFDPIPIHYCAPAGYAILKCNNKTFTGTGPCNNVSTVQCTHGIKPV
                                      251                                               300
CH505TF chimera SOSIP.664.v4.1  (240) VSTQLLLNGSLAEGEIIIRSENITNNVKTIIVHLNESVKIECTRPNNKTR
    HV1301003 CH505 TF gp160    (242) VSTQLLLNGSLAEGEIIIRSENITNNVKTIIVHLNESVKIECTRPNNKTR
          VRC4112 BG505 SOSIP   (225) VSTQLLLNGSLAEEEVMIRSENITNNAKNILVQFNTPVQINCTRPNNNTR
                    Consensus   (251) VSTQLLLNGSLAEGEIIIRSENITNNVKTIIVHLNESVKIECTRPNNKTR

                                      301 ↓      v4.1 mutation                           350
CH505TF chimera SOSIP.664.v4.1  (290) TSIRIGPGQWFYATGQVIGDIREAYCNINESKWNETLQRVSKKLKEYFPH
    HV1301003 CH505 TF gp160    (292) TSIRIGPGQAFYATGQVIGDIREAYCNINESKWNETLQRVSKKLKEYFPH
          VRC4112 BG505 SOSIP   (275) KSIRIGPGQAFYATGDIIGDIRQAHCNVSKATWNETLGKVVKQLRKHFGN
                    Consensus   (301) TSIRIGPGQAFYATGQVIGDIREAYCNINESKWNETLQRVSKKLKEYFPH
                                      351                                               400
CH505TF chimera SOSIP.664.v4.1  (340) KNITFQP-SSGGDLEITTHSFNCGGEFFYCNTSSLFNRTYMANSTDMANS
    HV1301003 CH505 TF gp160    (342) KNITFQP-SSGGDLEITTHSFNCGGEFFYCNTSSLFNRTYMANSTDMANS
          VRC4112 BG505 SOSIP   (325) NTIIRFANSSGGDLEVTTHSFNCGGEFFYCNTSGLFNSTWISNTSVQG-S
                    Consensus   (351) KNITFQP SSGGDLEITTHSFNCGGEFFYCNTSSLFNRTYMANSTDMANS
                                      401                                               450
CH505TF chimera SOSIP.664.v4.1  (389) TETNSTRTITIHCRIKQIINMWQEVGRAMYAPPIAGNITCISNITGLLLT
    HV1301003 CH505 TF gp160    (391) TETNSTRTITIHCRIKQIINMWQEVGRAMYAPPIAGNITCISNITGLLLT
          VRC4112 BG505 SOSIP   (374) NSTGSNDSITLPCRIKQIINMWQRIGQAMYAPPIQGVIRCVSNITGLILT
                    Consensus   (401) TETNSTRTITIHCRIKQIINMWQEVGRAMYAPPIAGNITCISNITGLLLT
```

Figure 23B cont.

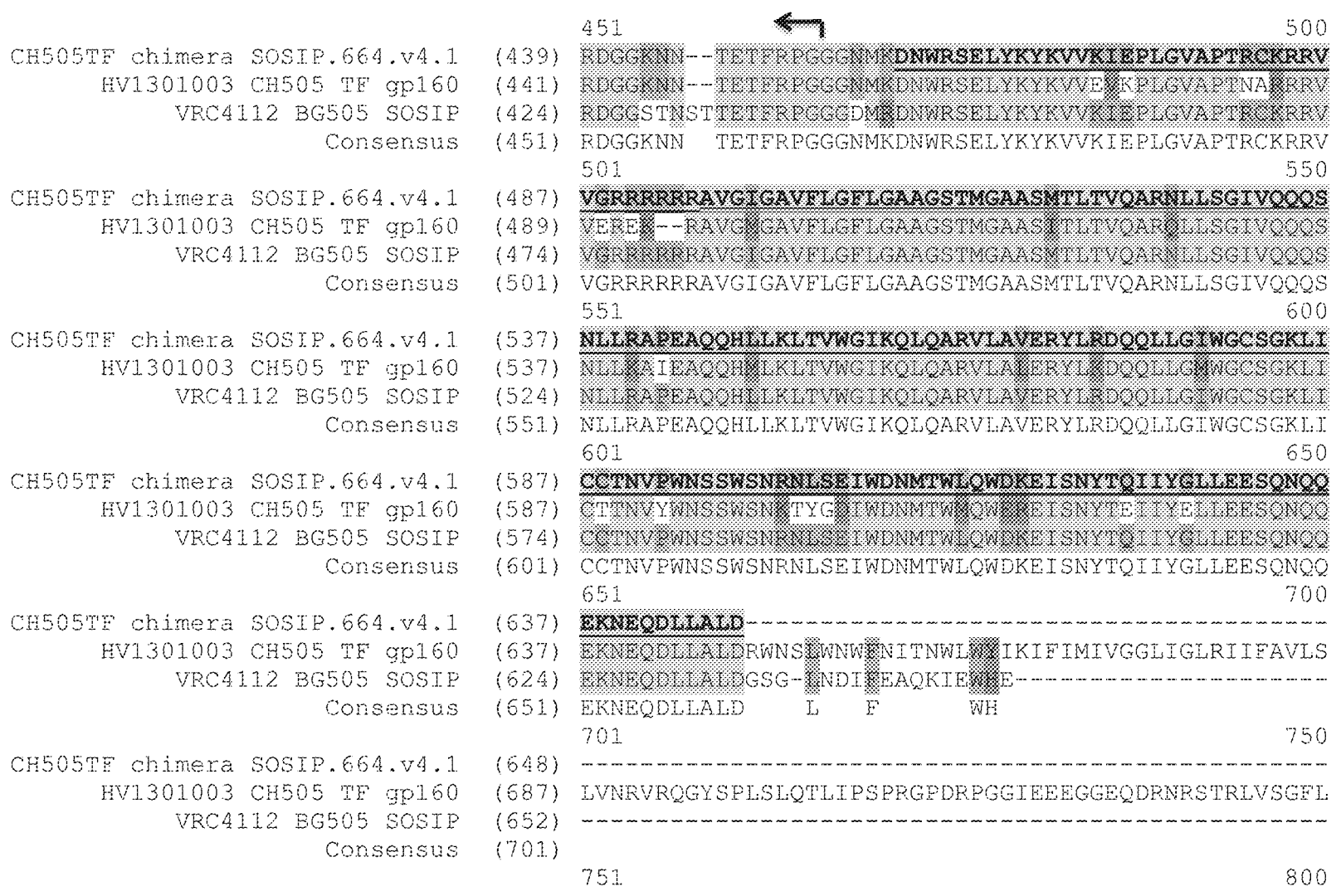

```
                                          451                                                500
CH505TF chimera SOSIP.664.v4.1   (439)  RDGGKNN--TETFRPGGGNMKDNWRSELYKYKVVKIEPLGVAPTRCKRRV
   HV1301003 CH505 TF gp160      (441)  RDGGKNN--TETFRPGGGNMKDNWRSELYKYKVVEIKPLGVAPTNAKRRV
         VRC4112 BG505 SOSIP     (424)  RDGGSTNSTTETFRPGGGDMRDNWRSELYKYKVVKIEPLGVAPTRCKRRV
                   Consensus     (451)  RDGGKNN  TETFRPGGGNMKDNWRSELYKYKVVKIEPLGVAPTRCKRRV
                                          501                                                550
CH505TF chimera SOSIP.664.v4.1   (487)  VGRRRRRRAVGIGAVFLGFLGAAGSTMGAASMTLTVQARNLLSGIVQQQS
   HV1301003 CH505 TF gp160      (489)  VEREK--RAVGIGAVFLGFLGAAGSTMGAASMTLTVQARNLLSGIVQQQS
         VRC4112 BG505 SOSIP     (474)  VGRRRRRRAVGIGAVFLGFLGAAGSTMGAASMTLTVQARNLLSGIVQQQS
                   Consensus     (501)  VGRRRRRRAVGIGAVFLGFLGAAGSTMGAASMTLTVQARNLLSGIVQQQS
                                          551                                                600
CH505TF chimera SOSIP.664.v4.1   (537)  NLLRAPEAQQHLLKLTVWGIKQLQARVLAVERYLRDQQLLGIWGCSGKLI
   HV1301003 CH505 TF gp160      (537)  NLLRAIEAQQHLLKLTVWGIKQLQARVLAVERYLRDQQLLGIWGCSGKLI
         VRC4112 BG505 SOSIP     (524)  NLLRAPEAQQHLLKLTVWGIKQLQARVLAVERYLRDQQLLGIWGCSGKLI
                   Consensus     (551)  NLLRAPEAQQHLLKLTVWGIKQLQARVLAVERYLRDQQLLGIWGCSGKLI
                                          601                                                650
CH505TF chimera SOSIP.664.v4.1   (587)  CCTNVPWNSSWSNRNLSEIWDNMTWLQWDKEISNYTQIIYGLLEESQNQQ
   HV1301003 CH505 TF gp160      (587)  CTTNVYWNSSWSNRTYGEIWDNMTWLQWDKEISNYTEIIYELLEESQNQQ
         VRC4112 BG505 SOSIP     (574)  CCTNVPWNSSWSNRNLSEIWDNMTWLQWDKEISNYTQIIYGLLEESQNQQ
                   Consensus     (601)  CCTNVPWNSSWSNRNLSEIWDNMTWLQWDKEISNYTQIIYGLLEESQNQQ
                                          651                                                700
CH505TF chimera SOSIP.664.v4.1   (637)  EKNEQDLLALD---------------------------------------
   HV1301003 CH505 TF gp160      (637)  EKNEQDLLALDRWNSLWNWFNITNWLWYIKIFIMIVGGLIGLRIIFAVLS
         VRC4112 BG505 SOSIP     (624)  EKNEQDLLALDGSG-LNDIFEAQKIEWHE---------------------
                   Consensus     (651)  EKNEQDLLALD    L   F      WH
                                          701                                                750
CH505TF chimera SOSIP.664.v4.1   (648)  --------------------------------------------------
   HV1301003 CH505 TF gp160      (687)  LVNRVRQGYSPLSLQTLIPSPRGPDRPGGIEEEGGEQDRNRSTRLVSGFL
         VRC4112 BG505 SOSIP     (652)  --------------------------------------------------
                   Consensus     (701)
                                          751                                                800
```

Figure 23B cont.

```
CH505TF chimera SOSIP.664.v4.1  (648) ----------------------------------------------------
HV1301003 CH505 TF gp160        (737) ALVWDDLRSLCLFIYHRLRDFILIAARAGELLGRSSLKGLRRGWEALKYL
VRC4112 BG505 SOSIP             (652) ----------------------------------------------------
Consensus                       (751)                                                  850

CH505TF chimera SOSIP.664.v4.1  (648) ----------------------------------------------------
HV1301003 CH505 TF gp160        (787) GSLVQYWGLELKRSAISLLDTLAIAVGEGTDRILEFVLGICRAIRNIPTR
VRC4112 BG505 SOSIP             (652) ----------------------------------------------------
Consensus                       (801) 801

CH505TF chimera SOSIP.664.v4.1  (648) ------------
HV1301003 CH505 TF gp160        (837) IRQGFETALL--
VRC4112 BG505 SOSIP             (652) ------------
Consensus                       (851) 851      861
```

Figure 23B cont.

>CH505TF.6R.SOSIP.664.v4.1_AMBRCTA (HV1301189_AMBRCTA) (SEQ ID NO. 277)

Signal peptide; <u>readthrough sequence</u>; *gp41 transmembrane and cytoplasmic tail*)

ATGCCCATGGGCAGCCTGCAGCCCCTGGCCACCCTGTACCTGCTGGGCATGCTGGTGGCTAGCGTGCTGGCC
GCCGAGAACCTGTGGGTGACCGTCTACTATGGCGTGCCCGTCTGGAAGGAAGCCAAAACCACACTGTTCTGC
GCTAGCGACGCTAAGGCATACGAGAAAAAAGTGCACAATGTCTGGGCTACTCATGCATGCGTGCCTACCGAT
CCAAATCCCCAGGAGATGGTGCTGAAGAACGTCACAGAAAACTTTAATATGTGGAAGAACGACATGGTGGAT
CAGATGCACGAGGACGTGATCAGCCTGTGGGATCAGTCCCTGAAGCCATGCGTGAAACTGACTCCCCTGTGC
GTCACCCTGAACTGTACTAATGCCACCGCTTCCAACAGCTCCATCATTGAGGGGATGAAGAACTGTTCTTTC
AATATCACTACCGAGCTGCGCGACAAGCGAGAAAAGAAAAATGCCCTGTTTTACAAACTGGACATCGTGCAG
CTGGATGGCAACTCTAGTCAGTATAGACTGATTAACTGCAATACAAGCGTGATCACTCAGGCATGTCCAAAG
GTCAGTTTCGATCCTATTCCAATCCACTACTGCGCACCCGCCGGATATGCTATCCTGAAGTGTAACAACAAG
ACCTTCACCGGCACTGGGCCTTGCAACAACGTGAGCACCGTCCAGTGTACACATGGCATTAAGCCAGTGGTC
AGCACCCAGCTGCTGCTGAACGGCAGCCTGGCAGAGGGCGAAATCATTATCCGCAGCGAGAACATCACAAAT
AATGTGAAGACTATCATCGTCCACCTGAACGAGAGCGTGAAGATTGAATGCACACGGCCCAACAACAAGACC
AGGACATCCATTCGCATCGGACCTGGCCAGTGGTTCTACGCTACTGGCCAGGTCATCGGGGACATCAGAGAG
GCCTATTGTAACATCAATGAGTCAAAGTGGAATGAAACTCTGCAGAGGGTGAGCAAGAAACTGAAGGAATAC
TTCCCTCACAAAAACATCACCTTTCAGCCATCAAGCGGCGGGGACCTGGAGATTACAACTCATTCTTTCAAT
TGCGGAGGCGAATTCTTTTACTGTAACACCTCCTCTCTGTTTAATCGCACATATATGGCTAACAGTACTGAT
ATGGCAAACTCTACTGAGACCAATAGTACACGAACTATTACCATCCATTGCCGGATCAAGCAGATTATCAAC
ATGTGGCAGGAAGTGGGGCGGGCCATGTATGCTCCCCCTATTGCAGGAAATATTACCTGTATCAGCAACATT
ACCGGCCTGCTGCTGACAAGAGACGGGGGAAAGAACAATACAGAGACTTTTAGGCCTGGCGGGGGAAACATG
AAAGATAATTGGCGCTCCGAGCTGTACAAGTATAAAGTGGTCAAGATCGAACCACTGGGAGTGGCACCTACC
CGATGTAAACGGAGAGTGGTCGGAAGGCGCCGACGGAGAAGGGCAGTGGGAATCGGAGCCGTCTTCCTGGGC
TTTCTGGGAGCAGCTGGCAGCACAATGGGAGCAGCCTCTATGACCCTGACAGTGCAGGCTCGAAATCTGCTG
AGTGGGATCGTGCAGCAGCAGTCAAACCTGCTGCGAGCACCAGAGGCACAGCAGCATCTGCTGAAGCTGACC
GTGTGGGGCATCAAGCAGCTGCAGGCCAGAGTGCTGGCTGTCGAACGGTACCTGAGAGATCAGCAGCTGCTG
GGAATCTGGGGATGCAGCGGAAAGCTGATTTGCTGTACAAACGTGCCCTGGAATAGTTCATGGTCAAACAGG
AATCTGAGCGAGATCTGGGACAATATGACCTGGCTGCAGTGGGATAAGGAAATCAGTAACTACACACAGATC
ATCTATGGCCTGCTGGAGGAATCACAGAACCAGCAGGAGAAAAATGAACAGGACCTGCTGGCCCTGGAT<u>TGA</u>
<u>CTA</u>*AAGTGGGCAAGTCTGTGGAATTGGTTTGACATATCAAACTGGCTGTGGTATATAAAAATATTTATAATG*
*ATAGTAGGAGGCTTAATAGGATTAAGAATAGTTTTTGCTGTGCTTTCTGTAATACATAGAGTTAGGCAGGGA*
*TACTCACCTTTGTCGTTTCAGACCCATACCCCAAACCCAAGGGGACTCGACAGGCCCGAAAGAATCGAAGAA*
*GAAGATGGAGAGCAAGACAGAGGCAGATCGACGCGATTAGTGAGCGGATTCTTAGCTCTTGCCTGGGACGAT*
*CTGAGGAGCCTGTGCCTCTTCTGCTACCACCGATTGAGAGACTTCATCTTGATTGCAGCGAGGATTGTGGAA*
*CTTCTGGGACACAGCAGTCTCAAGGGGTTGAGACTGGGGTGGGAAGGCCTCAAGTATCTGTGGAATCTCCTG*
*GCATATTGGGGTCGGGAACTAAAAATTAGTGCTATTAATTTGTTTGATACCATAGCAATAGCAGTAGCTGAG*
*TGGACAGATAGGGTTATAGAAATAGGACAAAGACTTTGTAGAGCTTTTCTCCACATACCTAGAAGAATCAGA*
*CAGGGCCTCGAAAGGGCTTTGCTATAATAA*

Figure 24A

>CH505TF.6R.SOSIP.664.v4.1_AMBRCTA (HV1301189_AMBRCTA) (SEQ ID NO. 278)

MPMGSLQPLATLYLLGMLVASVLAAENLWVTVYYGVPVWKEAKTTLFCASDAKAYEKKVH
NVWATHACVPTDPNPQEMVLKNVTENFNMWKNDMVDQMHEDVISLWDQSLKPCVKLTPLC
VTLNCTNATASNSSIIEGMKNCSFNITTELRDKREKKNALFYKLDIVQLDGNSSQYRLIN
CNTSVITQACPKVSFDPIPIHYCAPAGYAILKCNNKTFTGTGPCNNVSTVQCTHGIKPVV
STQLLLNGSLAEGEIIIRSENITNNVKTIIVHLNESVKIECTRPNNKTRTSIRIGPGQWF
YATGQVIGDIREAYCNINESKWNETLQRVSKKLKEYFPHKNITFQPSSGGDLEITTHSFN
CGGEFFYCNTSSLFNRTYMANSTDMANSTETNSTRTITIHCRIKQIINMWQEVGRAMYAP
PIAGNITCISNITGLLLTRDGGKNNTETFRPGGGNMKDNWRSELYKYKVVKIEPLGVAPT
RCKRRVVGRRRRRRAVGIGAVFLGFLGAAGSTMGAASMTLTVQARNLLSGIVQQQSNLLR
APEAQQHLLKLTVWGIKQLQARVLAVERYLRDQQLLGIWGCSGKLICCTNVPWNSSWSNR
NLSEIWDNMTWLQWDKEISNYTQIIYGLLEESQNQQEKNEQDLLALD*L*KWASLWNWFDI*
*SNWLWYIKIFIMIVGGLIGLRIVFAVLSVIHRVRQGYSPLSFQTHTPNPRGLDRPERIEE*
*EDGEQDRGRSTRLVSGFLALAWDDLRSLCLFCYHRLRDFILIAARIVELLGHSSLKGLRL*
*GWEGLKYLWNLLAYWGRELKISAINLFDTIAIAVAEWTDRVIEIGQRLCRAFLHIPRRIR*
*QGLERALL***

Figure 24A cont.

>CH505TF.6R.SOSIP.664.v4.1_AMBRCTAG (HV1301189_AMBRCTAG)(SEQ ID NO. 279)

ATGCCCATGGGCAGCCTGCAGCCCCTGGCCACCCTGTACCTGCTGGGCATGCTGGTGGCTAGCGTGCTGGCC
GCCGAGAACCTGTGGGTGACCGTCTACTATGGCGTGCCCGTCTGGAAGGAAGCCAAAACCACACTGTTCTGC
GCTAGCGACGCTAAGGCATACGAGAAAAAAGTGCACAATGTCTGGGCTACTCATGCATGCGTGCCTACCGAT
CCAAATCCCCAGGAGATGGTGCTGAAGAACGTCACAGAAAACTTTAATATGTGGAAGAACGACATGGTGGAT
CAGATGCACGAGGACGTGATCAGCCTGTGGGATCAGTCCCTGAAGCCATGCGTGAAACTGACTCCCCTGTGC
GTCACCCTGAACTGTACTAATGCCACCGCTTCCAACAGCTCCATCATTGAGGGGATGAAGAACTGTTCTTTC
AATATCACTACCGAGCTGCGCGACAAGCGAGAAAAGAAAAATGCCCTGTTTTACAAACTGGACATCGTGCAG
CTGGATGGCAACTCTAGTCAGTATAGACTGATTAACTGCAATACAAGCGTGATCACTCAGGCATGTCCAAAG
GTCAGTTTCGATCCTATTCCAATCCACTACTGCGCACCCGCCGGATATGCTATCCTGAAGTGTAACAACAAG
ACCTTCACCGGCACTGGGCCTTGCAACAACGTGAGCACCGTCCAGTGTACACATGGCATTAAGCCAGTGGTC
AGCACCCAGCTGCTGCTGAACGGCAGCCTGGCAGAGGGCGAAATCATTATCCGCAGCGAGAACATCACAAAT
AATGTGAAGACTATCATCGTCCACCTGAACGAGAGCGTGAAGATTGAATGCACACGGCCCAACAACAAGACC
AGGACATCCATTCGCATCGGACCTGGCCAGTGGTTCTACGCTACTGGCCAGGTCATCGGGGACATCAGAGAG
GCCTATTGTAACATCAATGAGTCAAAGTGGAATGAAACTCTGCAGAGGGTGAGCAAGAAACTGAAGGAATAC
TTCCCTCACAAAAACATCACCTTTCAGCCATCAAGCGGCGGGGACCTGGAGATTACAACTCATTCTTTCAAT
TGCGGAGGCGAATTCTTTTACTGTAACACCTCCTCTCTGTTTAATCGCACATATATGGCTAACAGTACTGAT
ATGGCAAACTCTACTGAGACCAATAGTACACGAACTATTACCATCCATTGCCGGATCAAGCAGATTATCAAC
ATGTGGCAGGAAGTGGGGCGGGCCATGTATGCTCCCCCTATTGCAGGAAATATTACCTGTATCAGCAACATT
ACCGGCCTGCTGCTGACAAGAGACGGGGGAAAGAACAATACAGAGACTTTTAGGCCTGGCGGGGGAAACATG
AAAGATAATTGGCGCTCCGAGCTGTACAAGTATAAAGTGGTCAAGATCGAACCACTGGGAGTGGCACCTACC
CGATGTAAACGGAGAGTGGTCGGAAGGCGCCGACGGAGAAGGGCAGTGGGAATCGGAGCCGTCTTCCTGGGC
TTTCTGGGAGCAGCTGGCAGCACAATGGGAGCAGCCTCTATGACCCTGACAGTGCAGGCTCGAAATCTGCTG
AGTGGGATCGTGCAGCAGCAGTCAAACCTGCTGCGAGCACCAGAGGCACAGCAGCATCTGCTGAAGCTGACC
GTGTGGGGCATCAAGCAGCTGCAGGCCAGAGTGCTGGCTGTCGAACGGTACCTGAGAGATCAGCAGCTGCTG
GGAATCTGGGGATGCAGCGGAAAGCTGATTTGCTGTACAAACGTGCCCTGGAATAGTTCATGGTCAAACAGG
AATCTGAGCGAGATCTGGGACAATATGACCTGGCTGCAGTGGGATAAGGAAATCAGTAACTACACACAGATC
ATCTATGGCCTGCTGGAGGAATCACAGAACCAGCAGGAGAAAAATGAACAGGACCTGCTGGCCCTGGATTGA
CTAGGC*AAGTGGGCAAGTCTGTGGAATTGGTTTGACATATCAAACTGGCTGTGGTATATAAAAATATTTATA*
*ATGATAGTAGGAGGCTTAATAGGATTAAGAATAGTTTTTGCTGTGCTTTCTGTAATACATAGAGTTAGGCAG*
*GGATACTCACCTTTGTCGTTTCAGACCCATACCCCAAACCCAAGGGGACTCGACAGGCCCGAAAGAATCGAA*
*GAAGAAGATGGAGAGCAAGACAGAGGCAGATCGACGCGATTAGTGAGCGGATTCTTAGCTCTTGCCTGGGAC*
*GATCTGAGGAGCCTGTGCCTCTTCTGCTACCACCGATTGAGAGACTTCATCTTGATTGCAGCGAGGATTGTG*
*GAACTTCTGGGACACAGCAGTCTCAAGGGGTTGAGACTGGGGTGGGAAGGCCTCAAGTATCTGTGGAATCTC*
*CTGGCATATTGGGGTCGGGAACTAAAAATTAGTGCTATTAATTTGTTTGATACCATAGCAATAGCAGTAGCT*
*GAGTGGACAGATAGGGTTATAGAAATAGGACAAAGACTTTGTAGAGCTTTTCTCCACATACCTAGAAGAATC*
*AGACAGGGCCTCGAAAGGGCTTTGCTATAATAA*

Figure 24A cont.

>CH505TF.6R.SOSIP.664.v4.1_AMBRCTAG(HV1301189_AMBRCTAG) (SEQ ID NO. 280)

MPMGSLQPLATLYLLGMLVASVLAAENLWVTVYYGVPVWKEAKTTLFCASDAKAYEKKVH
NVWATHACVPTDPNPQEMVLKNVTENFNMWKNDMVDQMHEDVISLWDQSLKPCVKLTPLC
VTLNCTNATASNSSIIEGMKNCSFNITTELRDKREKKNALFYKLDIVQLDGNSSQYRLIN
CNTSVITQACPKVSFDPIPIHYCAPAGYAILKCNNKTFTGTGPCNNVSTVQCTHGIKPVV
STQLLLNGSLAEGEIIIRSENITNNVKTIIVHLNESVKIECTRPNNKTRTSIRIGPGQWF
YATGQVIGDIREAYCNINESKWNETLQRVSKKLKEYFPHKNITFQPSSGGDLEITTHSFN
CGGEFFYCNTSSLFNRTYMANSTDMANSTETNSTRTITIHCRIKQIINMWQEVGRAMYAP
PIAGNITCISNITGLLLTRDGGKNNTETFRPGGGNMKDNWRSELYKYKVVKIEPLGVAPT
RCKRRVVGRRRRRRAVGIGAVFLGFLGAAGSTMGAASMTLTVQARNLLSGIVQQQSNLLR
APEAQQHLLKLTVWGIKQLQARVLAVERYLRDQQLLGIWGCSGKLICCTNVPWNSSWSNR
NLSEIWDNMTWLQWDKEISNYTQIIYGLLEESQNQQEKNEQDLLALD*LG_KWASLWNWFD_
_ISNWLWYIKIFIMIVGGLIGLRIVFAVLSVIHRVRQGYSPLSFQTHTPNPRGLDRPERIE_
_EEDGEQDRGRSTRLVSGFLALAWDDLRSLCLFCYHRLRDFILIAARIVELLGHSSLKGLR_
_LGWEGLKYLWNLLAYWGRELKISAINLFDTIAIAVAEWTDRVIEIGQRLCRAFLHIPRRI_
_RQGLERALL_**

Figure 24A cont.

>CH505M5chim.6R.SOSIP.664v4.1_AMBRCTA (SEQ ID NO. 281)

ATGCCCATGGGCTCCCTGCAGCCCCTGGCCACCCTGTACCTGCTGGGCATGCTCGTGGCCTCCGTGCTGGCC
GCCGAGAACCTGTGGGTGACCGTGTACTACGGCGTGCCCGTGTGGAAGGAGGCCAAGACCACCCTGTTCTGC
GCCTCCGACGCCAAGGCCTACGAGAAGAAGGTGCACAACGTGTGGGCCACCCACGCCTGCGTGCCCACCGAC
CCCAACCCCCAGGAGATGGTGCTGAAGAACGTGACCGAGAACTTCAACATGTGGAAGAACGACATGGTGGAC
CAGATGCACGAGGACGTGATCTCCCTGTGGGACCAGTCCCTGAAGCCCTGCGTGAAGCTGACCCCCCTGTGC
GTGACCCTGAACTGCACCAACGCCACCGCCTCCAACTCCTCCATCATCGAGGGCATGAAGAACTGCTCCTTC
AACATCACCACCGAGCTGCGCGACAAGCGCGAGAAGAAGAACGCCCTGTTCTACAAGCTGGACATCGTGCAG
CTGGACGGCAACTCCTCCCAGTACCGCCTGATCAACTGCAACACCTCCGTGATCACCCAGGCCTGCCCCAAG
GTGTCCTTCGACCCCATCCCCATCCACTACTGCGCCCCCGCCGGCTACGCCATCCTGAAGTGCAACAACAAG
ACCTTCACCGGCACCGGCCCCTGCAACAACGTGTCCACCGTGCAGTGCACCCACGGCATCAAGCCCGTGGTG
TCCACCCAGCTGCTGCTGAACGGCTCCCTGGCCGAGGGCGAGATCATCATCCGCTCCGAGAACATCACCAAG
AACGTGAAGACCATCATCGTGCACCTGAACGAGTCCGTGAAGATCGAGTGCACCCGCCCCAACAACAAGACC
CGCACCTCCATCCGCATCGGCCCCGGCCAGTGGTTCTACGCCACCGGCCAGGTGATCGGCGACATCCGCGAG
GCCTACTGCAACATCAACGAGTCCAAGTGGAACGAGACCCTGCAGCGCGTGTCCAAGAAGCTGAAGGAGTAC
TTCCCCCACAAGAACATCACCTTCCAGCCCTCCTCCGGCGGCGACCTGGAGATCACCACCCACTCCTTCAAC
TGCGGCGGCGAGTTCTTCTACTGCAACACCTCCTCCCTGTTCAACCGCACCTACATGGCCAACTCCACCGAC
ATGGCCAACTCCACCGAGACCAACTCCACCCGCACCATCACCATCCACTGCCGCATCAAGCAGATCATCAAC
ATGTGGCAGGAGGTGGGCCGCGCCATGTACGCCCCCCCCATCGCCGGCAACATCACCTGCATCTCCAACATC
ACCGGCCTGCTGCTGACCCGCGACGGCGGCAAGAACAACACCGAGACCTTCCGCCCCGGCGGCGGCAACATG
AAGGACAACTGGCGCTCCGAGCTGTACAAGTACAAGGTGGTGAAGATCGAGCCCCTGGGCGTGGCCCCCACC
CGCTGCAAGCGCCGCGTGGTGGGCCGCCGCCGCCGCCGCCGCGCCGTGGGCATCGGCGCCGTGTTCCTGGGC
TTCCTGGGCGCCGCCGGCTCCACCATGGGCGCCGCCTCCATGACCCTGACCGTGCAGGCCCGCAACCTGCTG
TCCGGCATCGTGCAGCAGCAGTCCAACCTGCTGCGCGCCCCCGAGGCCCAGCAGCACCTGCTGAAGCTGACC
GTGTGGGGCATCAAGCAGCTGCAGGCCCGCGTGCTGGCCGTGGAGCGCTACCTGCGCGACCAGCAGCTGCTG
GGCATCTGGGGCTGCTCCGGCAAGCTGATCTGCTGCACCAACGTGCCCTGGAACTCCTCCTGGTCCAACCGC
AACCTGTCCGAGATCTGGGACAACATGACCTGGCTGCAGTGGGACAAGGAGATCTCCAACTACACCCAGATC
ATCTACGGCCTGCTGGAGGAGTCCCAGAACCAGCAGGAGAAGAACGAGCAGGACCTGCTGGCCCTGGATTGA
CTAAAGTGGGCAAGTCTGTGGAATTGGTTTGACATATCAAACTGGCTGTGGTATATAAAAATATTTATAATG
ATAGTAGGAGGCTTAATAGGATTAAGAATAGTTTTTGCTGTGCTTTCTGTAATACATAGAGTTAGGCAGGGA
TACTCACCTTTGTCGTTTCAGACCCATACCCCAAACCCAAGGGGACTCGACAGGCCCGAAAGAATCGAAGAA
GAAGATGGAGAGCAAGACAGAGGCAGATCGACGCGATTAGTGAGCGGATTCTTAGCTCTTGCCTGGGACGAT
CTGAGGAGCCTGTGCCTCTTCTGCTACCACCGATTGAGAGACTTCATCTTGATTGCAGCGAGGATTGTGGAA
CTTCTGGGACACAGCAGTCTCAAGGGGTTGAGACTGGGGTGGGAAGGCCTCAAGTATCTGTGGAATCTCCTG
GCATATTGGGGTCGGGAACTAAAAATTAGTGCTATTAATTTGTTTGATACCATAGCAATAGCAGTAGCTGAG
TGGACAGATAGGGTTATAGAAATAGGACAAAGACTTTGTAGAGCTTTTCTCCACATACCTAGAAGAATCAGA
CAGGGCCTCGAAAGGCTTTGCTATAATAA

Figure 24A cont.

>CH505M5chim.6R.SOSIP.664v4.1_AMBRCTA (SEQ ID NO. 282)

MPMGSLQPLATLYLLGMLVASVLAAENLWVTVYYGVPVWKEAKTTLFCASDAKAYEKKVHNVWATHACVPTD
PNPQEMVLKNVTENFNMWKNDMVDQMHEDVISLWDQSLKPCVKLTPLCVTLNCTNATASNSSIIEGMKNCSF
NITTELRDKREKKNALFYKLDIVQLDGNSSQYRLINCNTSVITQACPKVSFDPIPIHYCAPAGYAILKCNNK
TFTGTGPCNNVSTVQCTHGIKPVVSTQLLLNGSLAEGEIIIRSENITKNVKTIIVHLNESVKIECTRPNNKT
RTSIRIGPGQWFYATGQVIGDIREAYCNINESKWNETLQRVSKKLKEYFPHKNITFQPSSGGDLEITTHSFN
CGGEFFYCNTSSLFNRTYMANSTDMANSTETNSTRTITIHCRIKQIINMWQEVGRAMYAPPIAGNITCISNI
TGLLLTRDGGKNNTETFRPGGGNMKDNWRSELYKYKVVKIEPLGVAPTRCKRRVVGRRRRRRAVGIGAVFLG
FLGAAGSTMGAASMTLTVQARNLLSGIVQQQSNLLRAPEAQQHLLKLTVWGIKQLQARVLAVERYLRDQQLL
GIWGCSGKLICCTNVPWNSSWSNRNLSEIWDNMTWLQWDKEISNYTQIIYGLLEESQNQQEKNEQDLLALD*
LKWASLWNWFDISNWLWYIKIFIMIVGGLIGLRIVFAVLSVIHRVRQGYSPLSFQTHTPNPRGLDRPERIEE
EDGEQDRGRSTRLVSGFLALAWDDLRSLCLFCYHRLRDFILIAARIVELLGHSSLKGLRLGWESLKYLWNLL
AYWGRELKISAINLFDTIAIAVAEWTDRVIEIGQRLCRAFLHIPRRIRQGLERALL**

Figure 24A cont.

>CH505M5chim.6R.SOSIP.664v4.1_AMBRCTAG (SEQ ID NO. 283)

ATGCCCATGGGCTCCCTGCAGCCCCTGGCCACCCTGTACCTGCTGGGCATGCTGGTGGCCTCCGTGCTGGCC
GCCGAGAACCTGTGGGTGACCGTGTACTACGGCGTGCCCGTGTGGAAGGAGGCCAAGACCACCCTGTTCTGC
GCCTCCGACGCCAAGGCCTACGAGAAGAAGGTGCACAACGTGTGGGCCACCCACGCCTGCGTGCCCACCGAC
CCCAACCCCCAGGAGATGGTGCTGAAGAACGTGACCGAGAACTTCAACATGTGGAAGAACGACATGGTGGAC
CAGATGCACGAGGACGTGATCTCCCTGTGGGACCAGTCCCTGAAGCCCTGCGTGAAGCTGACCCCCCTGTGC
GTGACCCTGAACTGCACCAACGCCACCGCCTCCAACTCCTCCATCATCGAGGGCATGAAGAACTGCTCCTTC
AACATCACCACCGAGCTGCGCGACAAGCGCGAGAAGAAGAACGCCCTGTTCTACAAGCTGGACATCGTGCAG
CTGGACGGCAACTCCTCCCAGTACCGCCTGATCAACTGCAACACCTCCGTGATCACCCAGGCCTGCCCCAAG
GTGTCCTTCGACCCCATCCCCATCCACTACTGCGCCCCCGCCGGCTACGCCATCCTGAAGTGCAACAACAAG
ACCTTCACCGGCACCGGCCCCTGCAACAACGTGTCCACCGTGCAGTGCACCCACGGCATCAAGCCCGTGGTG
TCCACCCAGCTGCTGCTGAACGGCTCCCTGGCCGAGGGCGAGATCATCATCCGCTCCGAGAACATCACCAAG
AACGTGAAGACCATCATCGTGCACCTGAACGAGTCCGTGAAGATCGAGTGCACCCGCCCCAACAACAAGACC
CGCACCTCCATCCGCATCGGCCCCGGCCAGTGGTTCTACGCCACCGGCCAGGTGATCGGCGACATCCGCGAG
GCCTACTGCAACATCAACGAGTCCAAGTGGAACGAGACCCTGCAGCGCGTGTCCAAGAAGCTGAAGGAGTAC
TTCCCCCACAAGAACATCACCTTCCAGCCCTCCTCCGGCGGCGACCTGGAGATCACCACCCACTCCTTCAAC
TGCGGCGGCGAGTTCTTCTACTGCAACACCTCCTCCCTGTTCAACCGCACCTACATGGCCAACTCCACCGAC
ATGGCCAACTCCACCGAGACCAACTCCACCCGCACCATCACCATCCACTGCCGCATCAAGCAGATCATCAAC
ATGTGGCAGGAGGTGGGCCGCGCCATGTACGCCCCCCCCATCGCCGGCAACATCACCTGCATCTCCAACATC
ACCGGCCTGCTGCTGACCCGCGACGGCGGCAAGAACAACACCGAGACCTTCCGCCCCGGCGGCGGCAACATG
AAGGACAACTGGCGCTCCGAGCTGTACAAGTACAAGGTGGTGAAGATCGAGCCCCTGGGCGTGGCCCCCACC
CGCTGCAAGCGCCGCGTGGTGGGCCGCCGCCGCCGCCGCCGCGCCGTGGGCATCGGCGCCGTGTTCCTGGGC
TTCCTGGGCGCCGCCGGCTCCACCATGGGCGCCGCCTCCATGACCCTGACCGTGCAGGCCCGCAACCTGCTG
TCCGGCATCGTGCAGCAGCAGTCCAACCTGCTGCGCGCCCCCGAGGCCCAGCAGCACCTGCTGAAGCTGACC
GTGTGGGGCATCAAGCAGCTGCAGGCCCGCGTGCTGGCCGTGGAGCGCTACCTGCGCGACCAGCAGCTGCTG
GGCATCTGGGGCTGCTCCGGCAAGCTGATCTGCTGCACCAACGTGCCCTGGAACTCCTCCTGGTCCAACCGC
AACCTGTCCGAGATCTGGGACAACATGACCTGGCTGCAGTGGGACAAGGAGATCTCCAACTACACCCAGATC
ATCTACGGCCTGCTGGAGGAGTCCCAGAACCAGCAGGAGAAGAACGAGCAGGACCTGCTGGCCCTGGATTGA
CTAGGCAAGTGGGCAAGTCTGTGGAATTGGTTTGACATATCAAACTGGCTGTGGTATATAAAAATATTTATA
ATGATAGTAGGAGGCTTAATAGGATTAAGAATAGTTTTTGCTGTGCTTTCTGTAATACATAGAGTTAGGCAG
GGATACTCACCTTTGTCGTTTCAGACCCATACCCCAAACCCAAGGGGACTCGACAGGCCCGAAAGAATCGAA
GAAGAAGATGGAGAGCAAGACAGAGGCAGATCGACGCGATTAGTGAGCGGATTCTTAGCTCTTGCCTGGGAC
GATCTGAGGAGCCTGTGCCTCTTCTGCTACCACCGATTGAGAGACTTCATCTTGATTGCAGCGAGGATTGTG
GAACTTCTGGGACACAGCAGTCTCAAGGGGTTGAGACTGGGGTGGGAAGGCCTCAAGTATCTGTGGAATCTC
CTGGCATATTGGGGTCGGGAACTAAAAATTAGTGCTATTAATTTGTTTGATACCATAGCAATAGCAGTAGCT
GAGTGGACAGATAGGGTTATAGAAATAGGACAAAGACTTTGTAGAGCTTTTCTCCACATACCTAGAAGAATC
AGACAGGGCCTCGAAAGGGCTTTGCTATAATAA

Figure 24A cont.

>CH505M5chim.6R.SOSIP.664v4.1_AMBRCTAG (SEQ ID NO. 284)

MPMGSLQPLATLYLLGMLVASVLAAENLWVTVYYGVPVWKEAKTTLFCASDAKAYEKKVHNVWATHACVPTD
PNPQEMVLKNVTENFNMWKNDMVDQMHEDVISLWDQSLKPCVKLTPLCVTLNCTNATASNSSIIEGMKNCSF
NITTELRDKREKKNALFYKLDIVQLDGNSSQYRLINCNTSVITQACPKVSFDPIPIHYCAPAGYAILKCNNK
TFTGTGPCNNVSTVQCTHGIKPVVSTQLLLNGSLAEGEIIIRSENITKNVKTIIVHLNESVKIECTRPNNKT
RTSIRIGPGQWFYATGQVIGDIREAYCNINESKWNETLQRVSKKLKEYFPHKNITFQPSSGGDLEITTHSFN
CGGEFFYCNTSSLFNRTYMANSTDMANSTETNSTRTITIHCRIKQIINMWQEVGRAMYAPPIAGNITCISNI
TGLLLTRDGGKNNTETFRPGGGNMKDNWRSELYKYKVVKIEPLGVAPTRCKRRVVGRRRRRRAVGIGAVFLG
FLGAAGSTMGAASMTLTVQARNLLSGIVQQQSNLLRAPEAQQHLLKLTVWGIKQLQARVLAVERYLRDQQLL
GIWGCSGKLICCTNVPWNSSWSNRNLSEIWDNMTWLQWDKEISNYTQIIYGLLEESQNQQEKNEQDLLALD*
LGKWASLWNWFDISNWLWYIKIFIMIVGGLIGLRIVFAVLSVIHRVRQGYSPLSFQTHTPNPRGLDRPERIE
EEDGEQDRGKSTRLVSGFLALAWDDLRSLCLFCYHRLRDFILIAARIVELLGHSSLKGLRLGWEGLKYLWNL
LAYWGRELKISAINLFDTIAIAVAEWTDRVIEIGQRLCRAFLHIPRRIRQGLERALL**

Figure 24A cont.

| | | 1 50 |
|---|---|---|
| CH505M5chim.6R.SOSIP.664v4.1_AMBRCTA **(SEQ ID NO. 285)** | (1) | MPMGSLQPLATLYLLGMLVASVLAAENLWVTVYYGVPVWKEAKTTLFCAS |
| CH505TF chimera SOSIP.664.v4.1AMber stopCTA**(SEQ ID NO. 286)** | (1) | MPMGSLQPLATLYLLGMLVASVLAAENLWVTVYYGVPVWKEAKTTLFCAS |
| CH505M5chim.6R.SOSIP.664v4.1_AMBRCTAG**(SEQ ID NO. 287)** | (1) | MPMGSLQPLATLYLLGMLVASVLAAENLWVTVYYGVPVWKEAKTTLFCAS |
| CH505TF chimera SOSIP.664.v4.1AMber stopCTAG**(SEQ ID NO. 288)** | (1) | MPMGSLQPLATLYLLGMLVASVLAAENLWVTVYYGVPVWKEAKTTLFCAS |
| Consensus | (1) | MPMGSLQPLATLYLLGMLVASVLAAENLWVTVYYGVPVWKEAKTTLFCAS |

| | | 51 100 |
|---|---|---|
| CH505M5chim.6R.SOSIP.664v4.1_AMBRCTA | (51) | DAKAYEKKVHNVWATHACVPTDPNPQEMVLKNVTENFNMWKNDMVDQMHE |
| CH505TF chimera SOSIP.664.v4.1AMber stopCTA | (51) | DAKAYEKKVHNVWATHACVPTDPNPQEMVLKNVTENFNMWKNDMVDQMHE |
| CH505M5chim.6R.SOSIP.664v4.1_AMBRCTAG | (51) | DAKAYEKKVHNVWATHACVPTDPNPQEMVLKNVTENFNMWKNDMVDQMHE |
| CH505TF chimera SOSIP.664.v4.1AMber stopCTAG | (51) | DAKAYEKKVHNVWATHACVPTDPNPQEMVLKNVTENFNMWKNDMVDQMHE |
| Consensus | (51) | DAKAYEKKVHNVWATHACVPTDPNPQEMVLKNVTENFNMWKNDMVDQMHE |

Figure 24A cont.

| | | |
|---|---|---|
| | | 101 150 |
| CH505M5chim.6R.SOSIP.664v4.1_AMBRCTA | (101) | DVISLWDQSLKPCVKLTPLCVTLNCTNATASNSSIIEGMKNCSFNITTEL |
| CH505TF chimera SOSIP.664.v4.1AMber stopCTA | (101) | DVISLWDQSLKPCVKLTPLCVTLNCTNATASNSSIIEGMKNCSFNITTEL |
| CH505M5chim.6R.SOSIP.664v4.1_AMBRCTAG | (101) | DVISLWDQSLKPCVKLTPLCVTLNCTNATASNSSIIEGMKNCSFNITTEL |
| CH505TF chimera SOSIP.664.v4.1AMber stopCTAG | (101) | DVISLWDQSLKPCVKLTPLCVTLNCTNATASNSSIIEGMKNCSFNITTEL |
| Consensus | (101) | DVISLWDQSLKPCVKLTPLCVTLNCTNATASNSSIIEGMKNCSFNITTEL |
| | | 151 200 |
| CH505M5chim.6R.SOSIP.664v4.1_AMBRCTA | (151) | RDKREKKNALFYKLDIVQLDGNSSQYRLINCNTSVITQACPKVSFDPIPI |
| CH505TF chimera SOSIP.664.v4.1AMber stopCTA | (151) | RDKREKKNALFYKLDIVQLDGNSSQYRLINCNTSVITQACPKVSFDPIPI |
| CH505M5chim.6R.SOSIP.664v4.1_AMBRCTAG | (151) | RDKREKKNALFYKLDIVQLDGNSSQYRLINCNTSVITQACPKVSFDPIPI |
| CH505TF chimera SOSIP.664.v4.1AMber stopCTAG | (151) | RDKREKKNALFYKLDIVQLDGNSSQYRLINCNTSVITQACPKVSFDPIPI |
| Consensus | (151) | RDKREKKNALFYKLDIVQLDGNSSQYRLINCNTSVITQACPKVSFDPIPI |
| | | 201 250 |
| CH505M5chim.6R.SOSIP.664v4.1_AMBRCTA | (201) | HYCAPAGYAILKCNNKTFTGTGPCNNVSTVQCTHGIKPVVSTQLLLNGSL |
| CH505TF chimera SOSIP.664.v4.1AMber stopCTA | (201) | HYCAPAGYAILKCNNKTFTGTGPCNNVSTVQCTHGIKPVVSTQLLLNGSL |
| CH505M5chim.6R.SOSIP.664v4.1_AMBRCTAG | (201) | HYCAPAGYAILKCNNKTFTGTGPCNNVSTVQCTHGIKPVVSTQLLLNGSL |
| CH505TF chimera SOSIP.664.v4.1AMber stopCTAG | (201) | HYCAPAGYAILKCNNKTFTGTGPCNNVSTVQCTHGIKPVVSTQLLLNGSL |
| Consensus | (201) | HYCAPAGYAILKCNNKTFTGTGPCNNVSTVQCTHGIKPVVSTQLLLNGSL |

Figure 24A cont.

| | | |
|---|---|---|
| | | 251 300 |
| CH505M5chim.6R.SOSIP.664v4.1_AMBRCTA | (251) | AEGEIIIRSENITKNVKTIIVHLNESVKIECTRPNNKTRTSIRIGPGQWF |
| CH505TF chimera SOSIP.664.v4.1AMber stopCTA | (251) | AEGEIIIRSENITNNVKTIIVHLNESVKIECTRPNNKTRTSIRIGPGQWF |
| CH505M5chim.6R.SOSIP.664v4.1_AMBRCTAG | (251) | AEGEIIIRSENITKNVKTIIVHLNESVKIECTRPNNKTRTSIRIGPGQWF |
| CH505TF chimera SOSIP.664.v4.1AMber stopCTAG | (251) | AEGEIIIRSENITNNVKTIIVHLNESVKIECTRPNNKTRTSIRIGPGQWF |
| Consensus | (251) | AEGEIIIRSENITNNVKTIIVHLNESVKIECTRPNNKTRTSIRIGPGQWF |
| | | 301 350 |
| CH505M5chim.6R.SOSIP.664v4.1_AMBRCTA | (301) | YATGQVIGDIREAYCNINESKWNETLQRVSKKLKEYFPHKNITFQPSSGG |
| CH505TF chimera SOSIP.664.v4.1AMber stopCTA | (301) | YATGQVIGDIREAYCNINESKWNETLQRVSKKLKEYFPHKNITFQPSSGG |
| CH505M5chim.6R.SOSIP.664v4.1_AMBRCTAG | (301) | YATGQVIGDIREAYCNINESKWNETLQRVSKKLKEYFPHKNITFQPSSGG |
| CH505TF chimera SOSIP.664.v4.1AMber stopCTAG | (301) | YATGQVIGDIREAYCNINESKWNETLQRVSKKLKEYFPHKNITFQPSSGG |
| Consensus | (301) | YATGQVIGDIREAYCNINESKWNETLQRVSKKLKEYFPHKNITFQPSSGG |
| | | 351 400 |
| CH505M5chim.6R.SOSIP.664v4.1_AMBRCTA | (351) | DLEITTHSFNCGGEFFYCNTSSLFNRTYMANSTDMANSTETNSTRTITIH |
| CH505TF chimera SOSIP.664.v4.1AMber stopCTA | (351) | DLEITTHSFNCGGEFFYCNTSSLFNRTYMANSTDMANSTETNSTRTITIH |
| CH505M5chim.6R.SOSIP.664v4.1_AMBRCTAG | (351) | DLEITTHSFNCGGEFFYCNTSSLFNRTYMANSTDMANSTETNSTRTITIH |
| CH505TF chimera SOSIP.664.v4.1AMber stopCTAG | (351) | DLEITTHSFNCGGEFFYCNTSSLFNRTYMANSTDMANSTETNSTRTITIH |
| Consensus | (351) | DLEITTHSFNCGGEFFYCNTSSLFNRTYMANSTDMANSTETNSTRTITIH |

Figure 24A cont.

| | | |
|---|---|---|
| | | 401 450 |
| CH505M5chim.6R.SOSIP.664v4.1_AMBRCTA | (401) | CRIKQIINMWQEVGRAMYAPPIAGNITCISNITGLLLTRDGGKNNTETFR |
| CH505TF chimera SOSIP.664.v4.1AMber stopCTA | (401) | CRIKQIINMWQEVGRAMYAPPIAGNITCISNITGLLLTRDGGKNNTETFR |
| CH505M5chim.6R.SOSIP.664v4.1_AMBRCTAG | (401) | CRIKQIINMWQEVGRAMYAPPIAGNITCISNITGLLLTRDGGKNNTETFR |
| CH505TF chimera SOSIP.664.v4.1AMber stopCTAG | (401) | CRIKQIINMWQEVGRAMYAPPIAGNITCISNITGLLLTRDGGKNNTETFR |
| Consensus | (401) | CRIKQIINMWQEVGRAMYAPPIAGNITCISNITGLLLTRDGGKNNTETFR |
| | | 451 500 |
| CH505M5chim.6R.SOSIP.664v4.1_AMBRCTA | (451) | PGGGNMKDNWRSELYKYKVVKIEPLGVAPTRCKRRVVGRRRRRRAVGIGA |
| CH505TF chimera SOSIP.664.v4.1AMber stopCTA | (451) | PGGGNMKDNWRSELYKYKVVKIEPLGVAPTRCKRRVVGRRRRRRAVGIGA |
| CH505M5chim.6R.SOSIP.664v4.1_AMBRCTAG | (451) | PGGGNMKDNWRSELYKYKVVKIEPLGVAPTRCKRRVVGRRRRRRAVGIGA |
| CH505TF chimera SOSIP.664.v4.1AMber stopCTAG | (451) | PGGGNMKDNWRSELYKYKVVKIEPLGVAPTRCKRRVVGRRRRRRAVGIGA |
| Consensus | (451) | PGGGNMKDNWRSELYKYKVVKIEPLGVAPTRCKRRVVGRRRRRRAVGIGA |
| | | 501 550 |
| CH505M5chim.6R.SOSIP.664v4.1_AMBRCTA | (501) | VFLGFLGAAGSTMGAASMTLTVQARNLLSGIVQQQSNLLRAPEAQQHLLK |
| CH505TF chimera SOSIP.664.v4.1AMber stopCTA | (501) | VFLGFLGAAGSTMGAASMTLTVQARNLLSGIVQQQSNLLRAPEAQQHLLK |
| CH505M5chim.6R.SOSIP.664v4.1_AMBRCTAG | (501) | VFLGFLGAAGSTMGAASMTLTVQARNLLSGIVQQQSNLLRAPEAQQHLLK |
| CH505TF chimera SOSIP.664.v4.1AMber stopCTAG | (501) | VFLGFLGAAGSTMGAASMTLTVQARNLLSGIVQQQSNLLRAPEAQQHLLK |
| Consensus | (501) | VFLGFLGAAGSTMGAASMTLTVQARNLLSGIVQQQSNLLRAPEAQQHLLK |

Figure 24A cont.

```
                                                       551                                               600
     CH505M5chim.6R.SOSIP.664v4.1_AMBRCTA  (551)  LTVWGIKQLQARVLAVERYLRDQQLLGIWGCSGKLICCTNVPWNSSWSNR
 CH505TF chimera SOSIP.664.v4.1AMber stopCTA  (551)  LTVWGIKQLQARVLAVERYLRDQQLLGIWGCSGKLICCTNVPWNSSWSNR
    CH505M5chim.6R.SOSIP.664v4.1_AMBRCTAG  (551)  LTVWGIKQLQARVLAVERYLRDQQLLGIWGCSGKLICCTNVPWNSSWSNR
CH505TF chimera SOSIP.664.v4.1AMber stopCTAG  (551)  LTVWGIKQLQARVLAVERYLRDQQLLGIWGCSGKLICCTNVPWNSSWSNR
                                Consensus  (551)  LTVWGIKQLQARVLAVERYLRDQQLLGIWGCSGKLICCTNVPWNSSWSNR
                                                       601                                               650
     CH505M5chim.6R.SOSIP.664v4.1_AMBRCTA  (601)  NLSEIWDNMTWLQWDKEISNYTQIIYGLLEESQNQQEKNEQDLLALD--▒
 CH505TF chimera SOSIP.664.v4.1AMber stopCTA  (601)  NLSEIWDNMTWLQWDKEISNYTQIIYGLLEESQNQQEKNEQDLLALD--▒
    CH505M5chim.6R.SOSIP.664v4.1_AMBRCTAG  (601)  NLSEIWDNMTWLQWDKEISNYTQIIYGLLEESQNQQEKNEQDLLALD-▒G
CH505TF chimera SOSIP.664.v4.1AMber stopCTAG  (601)  NLSEIWDNMTWLQWDKEISNYTQIIYGLLEESQNQQEKNEQDLLALD-▒G
                                Consensus  (601)  NLSEIWDNMTWLQWDKEISNYTQIIYGLLEESQNQQEKNEQDLLALD LL
                                                       651                                               700
     CH505M5chim.6R.SOSIP.664v4.1_AMBRCTA  (649)  KWASLWNWFDISNWLWYIKIFIMIVGGLIGLRIVFAVLSVIHRVRQGYSP
 CH505TF chimera SOSIP.664.v4.1AMber stopCTA  (649)  KWASLWNWFDISNWLWYIKIFIMIVGGLIGLRIVFAVLSVIHRVRQGYSP
    CH505M5chim.6R.SOSIP.664v4.1_AMBRCTAG  (650)  KWASLWNWFDISNWLWYIKIFIMIVGGLIGLRIVFAVLSVIHRVRQGYSP
CH505TF chimera SOSIP.664.v4.1AMber stopCTAG  (650)  KWASLWNWFDISNWLWYIKIFIMIVGGLIGLRIVFAVLSVIHRVRQGYSP
                                Consensus  (651)  KWASLWNWFDISNWLWYIKIFIMIVGGLIGLRIVFAVLSVIHRVRQGYSP
```

Figure 24A cont.

| | | |
|---|---|---|
| | | 701 750 |
| CH505M5chim.6R.SOSIP.664v4.1_AMBRCTA | (699) | LSFQTHTPNPRGLDRPERIEEEDGEQDRGRSTRLVSGFLALAWDDLRSLC |
| CH505TF chimera SOSIP.664.v4.1AMber stopCTA | (699) | LSFQTHTPNPRGLDRPERIEEEDGEQDRGRSTRLVSGFLALAWDDLRSLC |
| CH505M5chim.6R.SOSIP.664v4.1_AMBRCTAG | (700) | LSFQTHTPNPRGLDRPERIEEEDGEQDRGRSTRLVSGFLALAWDDLRSLC |
| CH505TF chimera SOSIP.664.v4.1AMber stopCTAG | (700) | LSFQTHTPNPRGLDRPERIEEEDGEQDRGRSTRLVSGFLALAWDDLRSLC |
| Consensus | (701) | LSFQTHTPNPRGLDRPERIEEEDGEQDRGRSTRLVSGFLALAWDDLRSLC |
| | | 751 800 |
| CH505M5chim.6R.SOSIP.664v4.1_AMBRCTA | (749) | LFCYHRLRDFILIAARIVELLGHSSLKGLRLGWEGLKYLWNLLAYWGREL |
| CH505TF chimera SOSIP.664.v4.1AMber stopCTA | (749) | LFCYHRLRDFILIAARIVELLGHSSLKGLRLGWEGLKYLWNLLAYWGREL |
| CH505M5chim.6R.SOSIP.664v4.1_AMBRCTAG | (750) | LFCYHRLRDFILIAARIVELLGHSSLKGLRLGWEGLKYLWNLLAYWGREL |
| CH505TF chimera SOSIP.664.v4.1AMber stopCTAG | (750) | LFCYHRLRDFILIAARIVELLGHSSLKGLRLGWEGLKYLWNLLAYWGREL |
| Consensus | (751) | LFCYHRLRDFILIAARIVELLGHSSLKGLRLGWEGLKYLWNLLAYWGREL |
| | | 801 850 |
| CH505M5chim.6R.SOSIP.664v4.1_AMBRCTA | (799) | KISAINLFDTIAIAVAEWTDRVIEIGQRLCRAFLHIPRRIRQGLERALL- |
| CH505TF chimera SOSIP.664.v4.1AMber stopCTA | (799) | KISAINLFDTIAIAVAEWTDRVIEIGQRLCRAFLHIPRRIRQGLERALL- |
| CH505M5chim.6R.SOSIP.664v4.1_AMBRCTAG | (800) | KISAINLFDTIAIAVAEWTDRVIEIGQRLCRAFLHIPRRIRQGLERALL- |
| CH505TF chimera SOSIP.664.v4.1AMber stopCTAG | (800) | KISAINLFDTIAIAVAEWTDRVIEIGQRLCRAFLHIPRRIRQGLERALL- |
| Consensus | (801) | KISAINLFDTIAIAVAEWTDRVIEIGQRLCRAFLHIPRRIRQGLERALL |

Figure 24A cont.

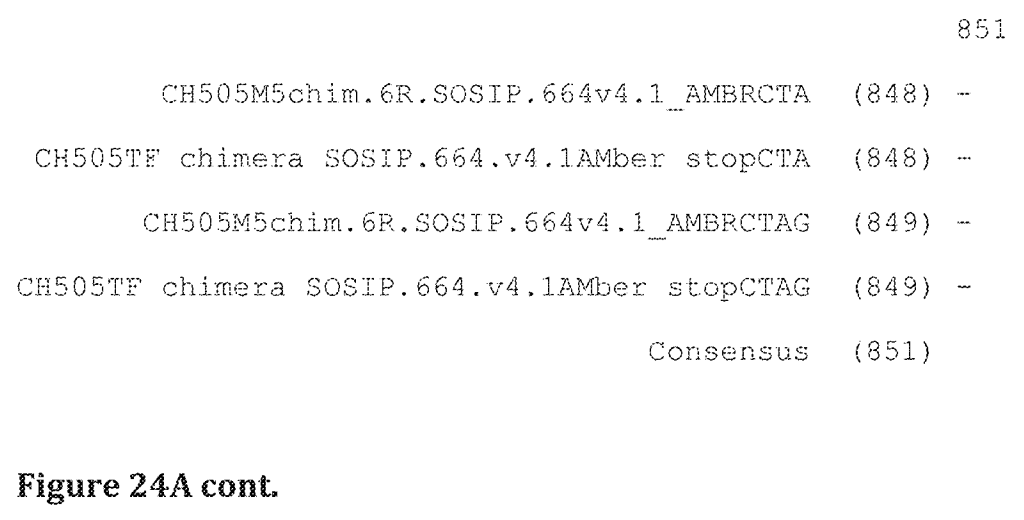

```
                                                      851
      CH505M5chim.6R.SOSIP.664v4.1_AMBRCTA   (848)  -
 CH505TF chimera SOSIP.664.v4.1AMber stopCTA   (848)  -
     CH505M5chim.6R.SOSIP.664v4.1_AMBRCTAG   (849)  -
CH505TF chimera SOSIP.664.v4.1AMber stopCTAG   (849)  -
                                   Consensus   (851)
```

Figure 24A cont.

Found BG505 sequence in genbank DQ208458.1

```
     M  R  V  M   G  I  Q   R  N  C   Q  H  L  F   R  W  G   T  M  I   L  G  M  I   I  I  C   S  A  A   E  N  L  W ·(SEQ ID NO. 290)
  1 ATGAGAGTGA TGGGGATACA GAGGAATTGT CAGCACTTAT TCAGATGGGG AACTATGATC TTGGGGATGA TAATAATCTG TAGTGCAGCA GAAAACTTGT  (SEQ ID NO. 289)
    TACTCTCACT ACCCCTATGT CTCCTTAACA GTCGTGAATA AGTCTACCCC TTGATACTAG AACCCCTACT ATTATTAGAC ATCACGTCGT CTTTTGAACA
    · V  T  V   Y  Y  G   V  P  V  W   K  D  A   E  T  T   L  F  C  A   S  D  A   K  A  Y   E  T  E  K   H  N  V ·
101 GGGTCACTGT CTACTATGGG GTACCTGTGT GGAAAGACGC AGAGACCACC TTATTTTGTG CATCAGATGC TAAAGCATAT GAGACAGAAA AGCATAATGT
    CCCAGTGACA GATGATACCC CATGGACACA CCTTTCTGCG TCTCTGGTGG AATAAAACAC GTAGTCTACG ATTTCGTATA CTCTGTCTTT TCGTATTACA
    ·W  A  T   H  A  C  V   P  T  D   P  N  P   Q  E  I  H   L  E  N   V  T  E   E  F  N  M   W  K  N   N  M  V
201 CTGGGCTACA CATGCCTGTG TACCCACAGA CCCCAACCCA CAAGAAATAC ATTTGGAAAA TGTGACTGAA GAGTTTAACA TGTGGAAAAA TAACATGGTA
    GACCCGATGT GTACGGACAC ATGGGTGTCT GGGGTTGGGT GTTCTTTATG TAAACCTTTT ACACTGACTT CTCAAATTGT ACACCTTTTT ATTGTACCAT
     E  Q  M  H   T  D  I   I  S  L   W  D  Q  S   L  K  P   C  V  K   L  T  P  L   C  V  T   L  Q  C   T  N  V  T ·
301 GAGCAGATGC ATACAGATAT CATCAGTCTA TGGGACCAAA GCCTAAAGCC ATGTGTAAAG TTAACCCCTC TCTGCGTTAC TCTACAGTGT ACCAATGTCA
    CTCGTCTACG TATGTCTATA GTAGTCAGAT ACCCTGGTTT CGGATTTCGG TACACATTTC AATTGGGGAG AGACGCAATG AGATGTCACA TGGTTACAGT
    · N  N  I   T  D  D   M  R  G  E   L  K  N   C  S  F   N  M  T  T   E  L  R   D  K  K   Q  K  V  Y   S  L  F ·
401 CCAATAATAT CACTGATGAC ATGAGGGGAG AATTAAAAAA CTGCTCTTTC AATATGACCA CAGAGCTAAG GGATAAGAAA CAGAAGGTTT ATTCACTTTT
    GGTTATTATA GTGACTACTG TACTCCCCTC TTAATTTTTT GACGAGAAAG TTATACTGGT GTCTCGATTC CCTATTCTTT GTCTTCCAAA TAAGTGAAAA
    ·Y  R  L   D  V  V  Q   I  N  E   N  Q  G   N  R  S  N   N  S  N   K  E  Y   R  L  I  N   C  N  T   S  A  I
501 TTATAGACTA GATGTAGTAC AAATTAACGA GAATCAAGGT AATAGGAGTA ATAATAGTAA CAAGGAGTAT AGATTAATAA ATTGTAATAC CTCAGCCATT
    AATATCTGAT CTACATCATG TTTAATTGCT CTTAGTTCCA TTATCCTCAT TATTATCATT GTTCCTCATA TCTAATTATT TAACATTATG GAGTCGGTAA
```

Figure 24A cont.

```
     T  Q  A  C  P  K  V  S  F  E  P  I  P  I  H  Y  C  A  P  A  G  F  A  I  L  K  C  K  D  K  K  F  N  G ·
 601 ACACAGGCTT GTCCAAAGGT ATCCTTTGAG CCAATTCCCA TACATTATTG TGCCCCAGCT GGTTTTGCGA TCCTAAAGTG TAAGGATAAG AAGTTCAATG
     TGTGTCCGAA CAGGTTTCCA TAGGAAACTC GGTTAAGGGT ATGTAATAAC ACGGGGTCGA CCAAAACGCT AGGATTTCAC ATTCCTATTC TTCAAGTTAC
     · T  G  P  C  P  S  V  S  T  V  Q  C  T  H  G  I  K  P  V  V  S  T  Q  L  L  L  N  G  S  L  A  E  E ·
 701 GAACAGGGCC ATGCCCAAGT GTCAGCACAG TACAATGCAC ACATGGAATC AAGCCAGTAG TATCAACTCA ACTGCTGTTA AATGGCAGTC TAGCAGAAGA
     CTTGTCCCGG TACGGGTTCA CAGTCGTGTC ATGTTACGTG TGTACCTTAG TTCGGTCATC ATAGTTGAGT TGACGACAAT TTACCGTCAG ATCGTCTTCT
     · E  V  M  I  R  S  E  N  I  T  N  N  A  K  N  I  L  V  Q  F  N  T  P  V  Q  I  N  C  T  R  P  N  N
 801 AGAGGTAATG ATTAGATCTG AAAATATCAC AAACAATGCC AAAAACATAC TAGTACAATT TAACACGCCT GTGCAAATTA ATTGTACCAG ACCTAACAAC
     TCTCCATTAC TAATCTAGAC TTTTATAGTG TTTGTTACGG TTTTTGTATG ATCATGTTAA ATTGTGCGGA CACGTTTAAT TAACATGGTC TGGATTGTTG
     N  T  R  K  S  I  R  I  G  P  G  Q  A  F  Y  A  T  G  D  I  I  G  D  I  R  Q  A  H  C  T  V  S  K  A ·
 901 AATACAAGGA AAAGTATACG TATAGGACCA GGACAAGCAT TCTATGCAAC AGGGGACATA ATAGGGGATA TAAGACAAGC ACATTGTACT GTCAGTAAAG
     TTATGTTCCT TTTCATATGC ATATCCTGGT CCTGTTCGTA AGATACGTTG TCCCCTGTAT TATCCCCTAT ATTCTGTTCG TGTAACATGA CAGTCATTTC
                                                                                                           XbaI
                                                                                                           ~~~
     · T  W  N  E  T  L  G  K  V  V  K  Q  L  R  K  H  F  G  N  N  T  I  I  R  F  A  N  S  S  G  G  D  L ·
1001 CAACATGGAA TGAAACTTTG GGAAAGGTGG TCAAACAATT AAGAAAACAC TTTGGGAACA ACACAATAAT AAGATTTGCT AATTCCTCAG GAGGGGATCT
     GTTGTACCTT ACTTTGAAAC CCTTTCCACC AGTTTGTTAA TTCTTTTGTG AAACCCTTGT TGTGTTATTA TTCTAAACGA TTAAGGAGTC CTCCCCTAGA
     XbaI
     ~~~
```

Figure 24A cont.

```
     ·E V T  T H S F  N C G  G E F  F Y C N  T S G  L F N  S T W I  S N T  S V Q
1101 AGAAGTCACA ACACATAGTT TTAATTGTGG AGGAGAATTT TTCTATTGTA ACACATCAGG CCTGTTCAAT AGCACTTGGA TTAGCAATAC CAGCGTGCAG
     TCTTCAGTGT TGTGTATCAA AATTAACACC TCCTCTTAAA AAGATAACAT TGTGTAGTCC GGACAAGTTA TCGTGAACCT AATCGTTATG GTCGCACGTC
      G S N S  T G S  N D S  I T L P  C R I  K Q I  I N M W  Q R I  G Q A  M Y A P·
1201 GGGTCAAATA GCACGGGGTC AAATGACAGT ATAACTCTCC CATGCAGAAT AAAGCAAATT ATAAATATGT GGCAGAGAAT AGGACAAGCA ATGTATGCCC
     CCCAGTTTAT CGTGCCCCAG TTTACTGTCA TATTGAGAGG GTACGTCTTA TTTCGTTTAA TATTTATACA CCGTCTCTTA TCCTGTTCGT TACATACGGG
     · P I Q  G V I  R C V S  N I T  G L I  L T R D  G G S  T N S  T T E T  F R P·
1301 CTCCCATCCA AGGAGTAATA AGATGTGTAT CAAACATTAC AGGGCTAATA TTAACAAGAG ATGGTGGGAG TACTAATAGT ACAACTGAAA CCTTCAGACC
     GAGGGTAGGT TCCTCATTAT TCTACACATA GTTTGTAATG TCCCGATTAT AATTGTTCTC TACCACCCTC ATGATTATCA TGTTGACTTT GGAAGTCTGG
     ·G G G  D M R D  N W R  S E L  Y K Y K  V V K  I E P  L G V A  P T R  A K R
1401 TGGAGGAGGA GATATGAGGG ACAATTGGAG AAGTGAATTA TATAAGTATA AAGTAGTAAA AATTGAACCA CTAGGAGTAG CACCCACCAG GGCAAAGAGA
     ACCTCCTCCT CTATACTCCC TGTTAACCTC TTCACTTAAT ATATTCATAT TTCATCATTT TTAACTTGGT GATCCTCATC GTGGGTGGTC CCGTTTCTCT
      R V V G  R E K  R A V  G I G A  V F L  G F L  G A A G  S T M  G A A  S M T L·
1501 AGAGTGGTGG GGAGAGAAAA AAGAGCAGTT GGAATAGGAG CTGTCTTCCT TGGGTTCTTA GGAGCAGCAG GAAGCACTAT GGGCGCGGCG TCAATGACGC
     TCTCACCACC CCTCTCTTTT TTCTCGTCAA CCTTATCCTC GACAGAAGGA ACCCAAGAAT CCTCGTCGTC CTTCGTGATA CCCGCGCCGC AGTTACTGCG
     · T V Q  A R N  L L S G  I V Q  Q Q S  N L L R  A I E  A Q Q  H L L K  L T V·
1601 TGACGGTACA GGCCAGAAAT TTATTATCTG GCATAGTGCA ACAGCAAAGC AATTTGCTGA GGGCTATAGA GGCTCAACAA CATCTGTTGA AACTCACGGT
     ACTGCCATGT CCGGTCTTTA AATAATAGAC CGTATCACGT TGTCGTTTCG TTAAACGACT CCCGATATCT CCGAGTTGTT GTAGACAACT TTGAGTGCCA
     ·W G I  K Q L Q  A R V  L A V  E R Y L  R D Q  Q L L  G I W G  C S G  K L I
1701 CTGGGGCATT AAACAGCTCC AGGCAAGGGT CCTGGCTGTG GAAAGATACC TAAGGGATCA ACAGCTTCTA GGAATTTGGG GCTGCTCTGG AAAACTCATC
     GACCCCGTAA TTTGTCGAGG TCCGTTCCCA GGACCGACAC CTTTCTATGG ATTCCCTAGT TGTCGAAGAT CCTTAAACCC CGACGAGACC TTTTGAGTAG
```

Figure 24A cont.

```
      C  T  T  N  V  P  W  N  S  S  W  S  N  R  N  L  S  E  I  W  D  N  M  T  W  L  Q  W  D  K  E  I  S  N·
1801 TGCACCACTA ATGTGCCCTG GAACTCTAGT TGGAGTAATA GAAACCTGAG TGAGATATGG GACAACATGA CCTGGCTGCA ATGGGATAAA GAAATTAGCA
     ACGTGGTGAT TACACGGGAC CTTGAGATCA ACCTCATTAT CTTTGGACTC ACTCTATACC CTGTTGTACT GGACCGACGT TACCCTATTT CTTTAATCGT
     · Y  T  Q  I  I  Y  G  L  L  E  E  S  Q  N  Q  Q  E  K  N  E  Q  D  L  L  A  L  D  K  W  A  S  L  W·
1901 ATTACACACA GATAATATAT GGGCTACTTG AAGAATCGCA GAACCAGCAG GAAAAGAATG AACAAGACTT ATTGGCATTG GATAAGTGGG CAAGTCTGTG
     TAATGTGTGT CTATTATATA CCCGATGAAC TTCTTAGCGT CTTGGTCGTC CTTTTCTTAC TTGTTCTGAA TAACCGTAAC CTATTCACCC GTTCAGACAC
     ·N  W  F  D  I  S  N  W  L  W  Y  I  K  I  F  I  M  I  V  G  G  L  I  G  L  R  I  V  F  A  V  L  S
2001 GAATTGGTTT GACATATCAA ACTGGCTGTG GTATATAAAA ATATTTATAA TGATAGTAGG AGGCTTAATA GGATTAAGAA TAGTTTTTGC TGTGCTTTCT
     CTTAACCAAA CTGTATAGTT TGACCGACAC CATATATTTT TATAAATATT ACTATCATCC TCCGAATTAT CCTAATTCTT ATCAAAAACG ACACGAAAGA
      V  I  H  R  V  R  Q  G  Y  S  P  L  S  F  Q  T  H  T  P  N  P  R  G  L  D  R  P  E  R  I  E  E  E  D·
2101 GTAATACATA GAGTTAGGCA GGGATACTCA CCTTTGTCGT TTCAGACCCA TACCCCAAAC CCAAGGGGAC TCGACAGGCC CGAAAGAATC GAAGAAGAAG
     CATTATGTAT CTCAATCCGT CCCTATGAGT GGAAACAGCA AAGTCTGGGT ATGGGGTTTG GGTTCCCCTG AGCTGTCCGG GCTTTCTTAG CTTCTTCTTC
     · G  E  Q  D  R  G  R  S  T  R  L  V  S  G  F  L  A  L  A  W  D  D  L  R  S  L  C  L  F  C  Y  H  R·
2201 ATGGAGAGCA AGACAGAGGC AGATCGACGC GATTAGTGAG CGGATTCTTA GCTCTTGCCT GGGACGATCT GAGGAGCCTG TGCCTCTTCT GCTACCACCG
     TACCTCTCGT TCTGTCTCCG TCTAGCTGCG CTAATCACTC GCCTAAGAAT CGAGAACGGA CCCTGCTAGA CTCCTCGGAC ACGGAGAAGA CGATGGTGGC
     ·L  R  D  F  I  L  I  A  A  R  I  V  E  L  L  G  H  S  S  L  K  G  L  R  L  G  W  E  G  L  K  Y  L
2301 ATTGAGAGAC TTCATCTTGA TTGCAGCGAG GATTGTGGAA CTTCTGGGAC ACAGCAGTCT CAAGGGGTTG AGACTGGGGT GGGAAGGCCT CAAGTATCTG
     TAACTCTCTG AAGTAGAACT AACGTCGCTC CTAACACCTT GAAGACCCTG TGTCGTCAGA GTTCCCCAAC TCTGACCCCA CCCTTCCGGA GTTCATAGAC
      W  N  L  L  A  Y  W  G  R  E  L  K  I  S  A  I  N  L  F  D  T  I  A  I  A  V  A  E  W  T  D  R  V  I·
2401 TGGAATCTCC TGGCATATTG GGGTCGGCAA CTAAAAATTA GTGCTATTAA TTTGTTTGAT ACCATAGCAA TAGCAGTAGC TGAGTGGACA GATAGGGTTA
     ACCTTAGAGG ACCGTATAAC CCCAGCCGTT GATTTTTAAT CACGATAATT AAACAAACTA TGGTATCGTT ATCGTCATCG ACTCACCTGT CTATCCCAAT
```

Figure 24A cont.

```
      · E  I  G  Q  R  L  C  R  A  F  L  H  I  P  P  R  I  R  Q  G  L  E  R  A  L  L  *
2501 TAGAAATAGG ACAAAGACTT TGTAGAGCTT TTCTCCACAT ACCTAGAAGA ATCAGACAGG GCCTCGAAAG CGGCTTTGCTA TAA
     ATCTTTATCC TGTTTCTGAA ACATCTCGAA AAGAGGTGTA TGGATCTTCT TAGTCTGTCC CGGAGCTTTC CCGAAACGAT ATT
```

Found amber codon read through motif(UGACTAG)in

Loughran atkins et al Nucleic acid research 2014.

CH505TF chimera SOSIP.664.v4.1AMber stopCTAG

Add CTA GGC(Leu Gly) after the amber stop codon UGA

```
      XbaI            NcoI        PstI                                          NheI
      ~~~~~~          ~~~~~~~     ~~~~~~~                                       ~~~~~~~
                   M  P  M  G  S  L  Q  P  L  A  T  L  Y  L  L  G  M  L  V  A  S  V  L  A  A  E  N  L  W  V ·  (SEQ ID NO. 292)
                                                                                                               (SEQ ID NO. 291)
1    TCTAGACCAC CATGCCCATG GGCAGCCTGC AGCCCCTGGC CACCCTGTAC CTGCTGGGCA TGCTGGTGGC TAGCGTGCTG GCCGCCGAGA ACCTGTGGGT
     AGATCTGGTG GTACGGGTAC CCGTCGGACG TCGGGGACCG GTGGGACATG GACGACCCGT ACGACCACCG ATCGCACGAC CGGCGGCTCT TGGACACCCA
                                                                  NheI                   ApaLI
                                                                  ~~~~~~~                ~~~~~~~
```

Figure 24A cont.

```
    ·T V Y  Y G V P  V W K  E A K  T T L F  C A S  D A K  A Y E K  K V H  N V W
101  GACCGTCTAC TATGGCGTGC CCGTCTGGAA GGAAGCCAAA ACCACACTGT TCTGCGCTAG CGACGCTAAG GCATACGAGA AAAAAGTGCA CAATGTCTGG
     CTGGCAGATG ATACCGCACG GGCAGACCTT CCTTCGGTTT TGGTGTGACA AGACGCGATC GCTGCGATTC CGTATGCTCT TTTTTCACGT GTTACAGACC
     A T H A  C V P  T D P  N P Q E  M V L  K N V  T E N F  N M W  K N D  M V D Q·
201  GCTACTCATG CATGCGTGCC TACCGATCCA AATCCCCAGG AGATGGTGCT GAAGAACGTC ACAGAAAACT TTAATATGTG GAAGAACGAC ATGGTGGATC
     CGATGAGTAC GTACGCACGG ATGGCTAGGT TTAGGGGTCC TCTACCACGA CTTCTTGCAG TGTCTTTTGA AATTATACAC CTTCTTGCTG TACCACCTAG
    · M H E  D V I  S L W D  Q S L  K P C  V K L T  P L C  V T L  N C T N  A T A·
301  AGATGCACGA GGACGTGATC AGCCTGTGGG ATCAGTCCCT GAAGCCATGC GTGAAACTGA CTCCCCTGTG CGTCACCCTG AACTGTACTA ATGCCACCGC
     TCTACGTGCT CCTGCACTAG TCGGACACCC TAGTCAGGGA CTTCGGTACG CACTTTGACT GAGGGGACAC GCAGTGGGAC TTGACATGAT TACGGTGGCG
    ·S N S  S I I E  G M K  N C S  F N I T  T E L  R D K  R E K K  N A L  F Y K
401  TTCCAACAGC TCCATCATTG AGGGGATGAA GAACTGTTCT TTCAATATCA CTACCGAGCT GCGCGACAAG CGAGAAAAGA AAAATGCCCT GTTTTACAAA
     AAGGTTGTCG AGGTAGTAAC TCCCCTACTT CTTGACAAGA AAGTTATAGT GATGGCTCGA CGCGCTGTTC GCTCTTTTCT TTTTACGGGA CAAAATGTTT
     L D I V  Q L D  G N S  S Q Y R  L I N  C N T  S V I T  Q A C  P K V  S F D P·
501  CTGGACATCG TGCAGCTGGA TGGCAACTCT AGTCAGTATA GACTGATTAA CTGCAATACA AGCGTGATCA CTCAGGCATG TCCAAAGGTC AGTTTCGATC
     GACCTGTAGC ACGTCGACCT ACCGTTGAGA TCAGTCATAT CTGACTAATT GACGTTATGT TCGCACTAGT GAGTCCGTAC AGGTTTCCAG TCAAAGCTAG
    · I P I  H Y C  A P A G  Y A I  L K C  N N K T  F T G  T G P  C N N V  S T V·
601  CTATTCCAAT CCACTACTGC GCACCCGCCG GATATGCTAT CCTGAAGTGT AACAACAAGA CCTTCACCGG CACTGGGCCT TGCAACAACG TGAGCACCGT
     GATAAGGTTA GGTGATGACG CGTGGGCGGC CTATACGATA GGACTTCACA TTGTTGTTCT GGAAGTGGCC GTGACCCGGA ACGTTGTTGC ACTCGTGGCA
```

Figure 24A cont.

```
     ·Q  C  T   H  G  I  K   P  V  V   S  T  Q   L  L  L  N   G  S  L   A  E  G   E  I  I  I   R  S  E   N  I  T
701   CCAGTGTACA CATGGCATTA AGCCAGTGGT CAGCACCCAG CTGCTGCTGA ACGGCAGCCT GGCAGAGGGC GAAATCATTA TCCGCAGCGA GAACATCACA
      GGTCACATGT GTACCGTAAT TCGGTCACCA GTCGTGGGTC GACGACGACT TGCCGTCGGA CCGTCTCCCG CTTTAGTAAT AGGCGTCGCT CTTGTAGTGT
      N  N  V  K   T  I  I   V  H  L   N  E  S  V   K  I  E   C  T  R   P  N  N  K   T  R  T   S  I  R   I  G  P  G·
801   AATAATGTGA AGACTATCAT CGTCCACCTG AACGAGAGCG TGAAGATTGA ATGCACACGG CCCAACAACA AGACCAGGAC ATCCATTCGC ATCGGACCTG
      TTATTACACT TCTGATAGTA GCAGGTGGAC TTGCTCTCGC ACTTCTAACT TACGTGTGCC GGGTTGTTGT TCTGGTCCTG TAGGTAAGCG TAGCCTGGAC
                                                                                                        PstI
                                                                                                      ~~~~~~~~
      · Q  W  F   Y  A  T   G  Q  V  I   G  D  I   R  E  A   Y  C  N  I   N  E  S   K  W  N   E  T  L  Q   R  V  S·
901   GCCAGTGGTT CTACGCTACT GGCCAGGTCA TCGGGGACAT CAGAGAGGCC TATTGTAACA TCAATGAGTC AAAGTGGAAT GAAACTCTGC AGAGGGTGAG
      CGGTCACCAA GATGCGATGA CCGGTCCAGT AGCCCCTGTA GTCTCTCCGG ATAACATTGT AGTTACTCAG TTTCACCTTA CTTTGAGACG TCTCCCACTC
      ·K  K  L   K  E  Y  F   P  H  K   N  I  T   F  Q  P  S   S  G  G   D  L  E   I  T  T  H   S  F  N   C  G  G
1001  CAAGAAACTG AAGGAATACT TCCCTCACAA AAACATCACC TTTCAGCCAT CAAGCGGCGG GGACCTGGAG ATTACAACTC ATTCTTTCAA TTGCGGAGGC
      GTTCTTTGAC TTCCTTATGA AGGGAGTGTT TTTGTAGTGG AAAGTCGGTA GTTCGCCGCC CCTGGACCTC TAATGTTGAG TAAGAAAGTT AACGCCTCCG
      EcoRI
      ~~~~~~
      E  F  F  Y   C  N  T   S  S  L   F  N  R  T   Y  M  A   N  S  T   D  M  A  N   S  T  E   T  N  S   T  R  T  I·
1101  GAATTCTTTT ACTGTAACAC CTCCTCTCTG TTTAATCGCA CATATATGGC TAACAGTACT GATATGGCAA ACTCTACTGA GACCAATAGT ACACGAACTA
      CTTAAGAAAA TGACATTGTG GAGGAGAGAC AAATTAGCGT GTATATACCG ATTGTCATGA CTATACCGTT TGAGATGACT CTGGTTATCA TGTGCTTGAT
```

Figure 24A cont.

```
        · T  I  H   C  R  I   K  Q  I   I  N  M   W  Q  E   V  G  R   A  M  Y   A  P  P   I  A  G   N  I  T   C  I  S ·
1201    TTACCATCCA TTGCCGGATC AAGCAGATTA TCAACATGTG GCAGGAAGTG GGGCGGGCCA TGTATGCTCC CCCTATTGCA GGAAATATTA CCTGTATCAG
        AATGGTAGGT AACGGCCTAG TTCGTCTAAT AGTTGTACAC CGTCCTTCAC CCCGCCCGGT ACATACGAGG GGGATAACGT CCTTTATAAT GGACATAGTC

        ·N  I  T   G  L  L   L  T  R   D  G  G   K  N  N   T  E  T   F  R  P   G  G  G   N  M  K   D  N  W   R  S  E
1301    CAACATTACC GGCCTGCTGC TGACAAGAGA CGGGGGAAAG AACAATACAG AGACTTTTAG GCCTGGCGGG GGAAACATGA AAGATAATTG GCGCTCCGAG
        GTTGTAATGG CCGGACGACG ACTGTTCTCT GCCCCCTTTC TTGTTATGTC TCTGAAAATC CGGACCGCCC CCTTTGTACT TTCTATTAAC CGCGAGGCTC

         L  Y  K   Y  K  V   V  K  I   E  P  L   G  V  A   P  T  R   C  K  R   R  V  V   G  R  R   R  R  R   R  A  V  G ·
1401    CTGTACAAGT ATAAAGTGGT CAAGATCGAA CCACTGGGAG TGGCACCTAC CCGATGTAAA CGGAGAGTGG TCGGAAGGCG CCGACGGAGA AGGGCAGTGG
        GACATGTTCA TATTTCACCA GTTCTAGCTT GGTGACCCTC ACCGTGGATG GGCTACATTT GCCTCTCACC AGCCTTCCGC GGCTGCCTCT TCCCGTCACC

        · I  G  A   V  F  L   G  F  L   G  A  A   G  S  T   M  G  A   A  S  M   T  L  T   V  Q  A   R  N  L   L  S  G ·
1501    GAATCGGAGC CGTCTTCCTG GGCTTTCTGG GAGCAGCTGG CAGCACAATG GGAGCAGCCT CTATGACCCT GACAGTGCAG GCTCGAAATC TGCTGAGTGG
        CTTAGCCTCG GCAGAAGGAC CCGAAAGACC CTCGTCGACC GTCGTGTTAC CCTCGTCGGA GATACTGGGA CTGTCACGTC CGAGCTTTAG ACGACTCACC

                                                                                                   PstI
                                                                                                  ~~~~~~~
        ·I  V  Q   Q  Q  S   N  L  L   R  A  P   E  A  Q   Q  H  L   L  K  L   T  V  W   G  I  K   Q  L  Q   A  R  V
1601    GATCGTGCAG CAGCAGTCAA ACCTGCTGCG AGCACCAGAG GCACAGCAGC ATCTGCTGAA GCTGACCGTG TGGGGCATCA AGCAGCTGCA GGCCAGAGTG
        CTAGCACGTC GTCGTCAGTT TGGACGACGC TCGTGGTCTC CGTGTCGTCG TAGACGACTT CGACTGGCAC ACCCCGTAGT TCGTCGACGT CCGGTCTCAC
```

Figure 24A cont.

```
        L  A  V  E  R  Y  L  R  D  Q  Q  L  L  G  I  W  G  C  S  G  K  L  I  C  C  T  N  V  P  W  N  S  S  W·
1701    CTGGCTGTCG AACGGTACCT GAGAGATCAG CAGCTGCTGG GAATCTGGGG ATGCAGCGGA AAGCTGATTT GCTGTACAAA CGTGCCCTGG AATAGTTCAT
        GACCGACAGC TTGCCATGGA CTCTCTAGTC GTCGACGACC CTTAGACCCC TACGTCGCCT TTCGACTAAA CGACATGTTT GCACGGGACC TTATCAAGTA
                                                PstI
                                              ~~~~~~~
       · S  N  R  N  L  S  E  I  W  D  N  M  T  W  L  Q  W  D  K  E  I  S  N  Y  T  Q  I  I  Y  G  L  L  E·
1801    GGTCAAACAG GAATCTGAGC GAGATCTGGG ACAATATGAC CTGGCTGCAG TGGGATAAGG AAATCAGTAA CTACACACAG ATCATCTATG GCCTGCTGGA
        CCAGTTTGTC CTTAGACTCG CTCTAGACCC TGTTATACTG GACCGACGTC ACCCTATTCC TTTAGTCATT GATGTGTGTC TAGTAGATAC CGGACGACCT
       ·E  S  Q  N  Q  Q  E  K  N  E  Q  D  L  L  A  L  D  *  L  G  K  W  A  S  L  W  N  W  F  D  I  S  N
1901    GGAATCACAG AACCAGCAGG AGAAAAATGA ACAGGACCTG CTGGCCCTGG ATTGACTAGG CAAGTGGGCA AGTCTGTGGA ATTGGTTTGA CATATCAAAC
        CCTTAGTGTC TTGGTCGTCC TCTTTTTACT TGTCCTGGAC GACCGGGACC TAACTGATCC GTTCACCCGT TCAGACACCT TAACCAAACT GTATAGTTTG
        W  L  W  Y  I  K  I  F  I  M  I  V  G  G  L  I  G  L  R  I  V  F  A  V  L  S  V  I  H  R  V  R  Q  G·
2001    TGGCTGTGGT ATATAAAAAT ATTTATAATG ATAGTAGGAG GCTTAATAGG ATTAAGAATA GTTTTTGCTG TGCTTTCTGT AATACATAGA GTTAGGCAGG
        ACCGACACCA TATATTTTTA TAAATATTAC TATCATCCTC CGAATTATCC TAATTCTTAT CAAAAACGAC ACGAAAGACA TTATGTATCT CAATCCGTCC
       · Y  S  P  L  S  F  Q  T  H  T  P  N  P  R  G  L  D  R  P  E  R  I  E  E  E  D  G  E  Q  D  R  G  R·
2101    GATACTCACC TTTGTCGTTT CAGACCCATA CCCCAAACCC AAGGGGACTC GACAGGCCCG AAAGAATCGA AGAAGAAGAT GGAGAGCAAC ACAGAGGCAG
        CTATGAGTGG AAACAGCAAA GTCTGGGTAT GGGGTTTGGG TTCCCCTGAG CTGTCCGGGC TTTCTTAGCT TCTTCTTCTA CCTCTCGTTG TGTCTCCGTC
       ·S  T  R  L  V  S  G  F  L  A  L  A  W  D  D  L  R  S  L  C  L  F  C  Y  H  R  L  R  D  F  I  L  I
2201    ATCGACGCGA TTAGTGAGCG GATTCTTAGC TCTTGCCTGG GACGATCTGA GGAGCCTGTG CCTCTTCTGC TACCACCGAT TGAGAGACTT CATCTTGATT
        TAGCTGCGCT AATCACTCGC CTAAGAATCG AGAACGGACC CTGCTAGACT CCTCGGACAC GGAGAAGACG ATGGTGGCTA ACTCTCTGAA GTAGAACTAA
```

Figure 24A cont.

```
          A  A  R  I  V  E  L  L  G  H  S  S  L  K  G  L  R  L  G  W  E  G  L  K  Y  L  W  N  L  L  A  Y  W  G
2301    GCAGCGAGGA TTGTGGAACT TCTGGGACAC AGCAGTCTCA AGGGGTTGAG ACTGGGGTGG GAAGGCCTCA AGTATCTGTG GAATCTCCTG GCATATTGGG
        CGTCGCTCCT AACACCTTGA AGACCCTGTG TCGTCAGAGT TCCCCAACTC TGACCCCACC CTTCCGGAGT TCATAGACAC CTTAGAGGAC CGTATAACCC
         · R  E  L  K  I  S  A  I  N  L  F  D  T  I  A  I  A  V  A  E  W  T  D  R  V  I  E  I  G  Q  R  L  C ·
2401    GTCGGGAACT AAAAATTAGT GCTATTAATT TGTTTGATAC CATAGCAATA GCAGTAGCTG AGTGGACAGA TAGGGTTATA GAAATAGGAC AAAGACTTTG
        CAGCCCTTGA TTTTTAATCA CGATAATTAA ACAAACTATG GTATCGTTAT CGTCATCGAC TCACCTGTCT ATCCCAATAT CTTTATCCTG TTTCTGAAAC
                                                                                  BamHI
                                                                                  ~~~~~~
         · R  A  F  L  H  I  P  R  R  I  R  Q  G  L  E  R  A  L  L  *  *
2501    TAGAGCTTTT CTCCACATAC CTAGAAGAAT CAGACAGGGC CTCGAAAGGG CTTTGCTATA ATAAGGATCC
        ATCTCGAAAA GAGGTGTATG GATCTTCTTA GTCTGTCCCG GAGCTTTCCC GAAACGATAT TATTCCTAGG
```

CH505TF chimera SOSIP.664.v4.1AMber stopCTA

```
         XbaI          NcoI       PstI                                  NheI
         ~~~~~~        ~~~~~~~    ~~~~~~~                               ~~~~~~~
                                                                                            (SEQ ID NO. 294)
                     M  P  M  G  S  L  Q  P  L  A  T  L  Y  L  L  G  M  L  V  A  S  V  L  A  A  E  N  L  W  V ·
                                                                                              (SEQ ID NO. 293)
1       TCTAGACCAC CATGCCCATG GGCAGCCTGC AGCCCCTGGC CACCCTGTAC CTGCTGGGCA TGCTGGTGGC TAGCGTGCTG GCCGCCGAGA ACCTGTGGGT
        AGATCTGGTG GTACGGGTAC CCGTCGGACG TCGGGGACCG GTGGGACATG GACGACCCGT ACGACCACCG ATCGCACGAC CGGCGGCTCT TGGACACCCA
                                                                  NheI                     ApaLI
                                                                  ~~~~~~~                  ~~~~~~~
```

Figure 24A cont.

```
     ·T  V  Y   Y  G  V  P   V  W  K   E  A  K   T  T  L  F   C  A  S   D  A  K   A  Y  E  K   K  V  H   N  V  W
101    GACCGTCTAC TATGGCGTGC CCGTCTGGAA GGAAGCCAAA ACCACACTGT TCTGCGCTAG CGACGCTAAG GCATACGAGA AAAAAGTGCA CAATGTCTGG
       CTGGCAGATG ATACCGCACG GGCAGACCTT CCTTCGGTTT TGGTGTGACA AGACGCGATC GCTGCGATTC CGTATGCTCT TTTTTCACGT GTTACAGACC
      A  T  H  A   C  V  P   T  D  P   N  P  Q  E   M  V  L   K  N  V   T  E  N  F   N  M  W   K  N  D   M  V  D  Q·
201    GCTACTCATG CATGCGTGCC TACCGATCCA AATCCCCAGG AGATGGTGCT GAAGAACGTC ACAGAAAACT TTAATATGTG GAAGAACGAC ATGGTGGATC
       CGATGAGTAC GTACGCACGG ATGGCTAGGT TTAGGGGTCC TCTACCACGA CTTCTTGCAG TGTCTTTTGA AATTATACAC CTTCTTGCTG TACCACCTAG
     · M  H  E   D  V  I   S  L  W  D   Q  S  L   K  P  C   V  K  L  T   P  L  C   V  T  L   N  C  T  N   A  T  A·
301    AGATGCACGA GGACGTGATC AGCCTGTGGG ATCAGTCCCT GAAGCCATGC GTGAAACTGA CTCCCCTGTG CGTCACCCTG AACTGTACTA ATGCCACCGC
       TCTACGTGCT CCTGCACTAG TCGGACACCC TAGTCAGGGA CTTCGGTACG CACTTTGACT GAGGGGACAC GCAGTGGGAC TTGACATGAT TACGGTGGCG
     ·S  N  S   S  I  I  E   G  M  K   N  C  S   F  N  I  T   T  E  L   R  D  K   R  E  K  K   N  A  L   F  Y  K
401    TTCCAACAGC TCCATCATTG AGGGGATGAA GAACTGTTCT TTCAATATCA CTACCGAGCT GCGCGACAAG CGAGAAAAGA AAAATGCCCT GTTTTACAAA
       AAGGTTGTCG AGGTAGTAAC TCCCCTACTT CTTGACAAGA AAGTTATAGT GATGGCTCGA CGCGCTGTTC GCTCTTTTCT TTTTACGGGA CAAAATGTTT
      L  D  I  V   Q  L  D   G  N  S   S  Q  Y  R   L  I  N   C  N  T   S  V  I  T   Q  A  C   P  K  V   S  F  D  P·
501    CTGGACATCG TGCAGCTGGA TGGCAACTCT AGTCAGTATA GACTGATTAA CTGCAATACA AGCGTGATCA CTCAGGCATG TCCAAAGGTC AGTTTCGATC
       GACCTGTAGC ACGTCGACCT ACCGTTGAGA TCAGTCATAT CTGACTAATT GACGTTATGT TCGCACTAGT GAGTCCGTAC AGGTTTCCAG TCAAAGCTAG
     · I  P  I   H  Y  C   A  P  A  G   Y  A  I   L  K  C   N  N  K  T   F  T  G   T  G  P   C  N  N  V   S  T  V·
601    CTATTCCAAT CCACTACTGC GCACCCGCCG GATATGCTAT CCTGAAGTGT AACAACAAGA CCTTCACCGG CACTGGGCCT TGCAACAACG TGAGCACCGT
       GATAAGGTTA GGTGATGACG CGTGGGCGGC CTATACGATA GGACTTCACA TTGTTGTTCT GGAAGTGGCC GTGACCCGGA ACGTTGTTGC ACTCGTGGCA
```

Figure 24A cont.

```
      ·Q  C  T   H  G  I  K   P  V  V   S  T  Q   L  L  L  N   G  S  L   A  E  G   E  I  I  I   R  S  E   N  I  T
701    CCAGTGTACA CATGGCATTA AGCCAGTGGT CAGCACCCAG CTGCTGCTGA ACGGCAGCCT GGCAGAGGGC GAAATCATTA TCCGCAGCGA GAACATCACA
       GGTCACATGT GTACCGTAAT TCGGTCACCA GTCGTGGGTC GACGACGACT TGCCGTCGGA CCGTCTCCCG CTTTAGTAAT AGGCGTCGCT CTTGTAGTGT
       N  N  V  K   T  I  I   V  H  L   N  E  S  V   K  I  E   C  T  R   P  N  N  K   T  R  T   S  I  R   I  G  P  G·
801    AATAATGTGA AGACTATCAT CGTCCACCTG AACGAGAGCG TGAAGATTGA ATGCACACGG CCCAACAACA AGACCAGGAC ATCCATTCGC ATCGGACCTG
       TTATTACACT TCTGATAGTA GCAGGTGGAC TTGCTCTCGC ACTTCTAACT TACGTGTGCC GGGTTGTTGT TCTGGTCCTG TAGGTAAGCG TAGCCTGGAC
                                                                                                            PstI
                                                                                                          ~~~~~~~
      · Q  W  F   Y  A  T   G  Q  V  I   G  D  I   R  E  A   Y  C  N  I   N  E  S   K  W  N   E  T  L  Q   R  V  S·
901    GCCAGTGGTT CTACGCTACT GGCCAGGTCA TCGGGGACAT CAGAGAGGCC TATTGTAACA TCAATGAGTC AAAGTGGAAT GAAACTCTGC AGAGGGTGAG
       CGGTCACCAA GATGCGATGA CCGGTCCAGT AGCCCCTGTA GTCTCTCCGG ATAACATTGT AGTTACTCAG TTTCACCTTA CTTTGAGACG TCTCCCACTC
      ·K  K  L   K  E  Y  F   P  H  K   N  I  T   F  Q  P  S   S  G  G   D  L  E   I  T  T  H   S  F  N   C  G  G
1001   CAAGAAACTG AAGGAATACT TCCCTCACAA AAACATCACC TTTCAGCCAT CAAGCGGCGG GGACCTGGAG ATTACAACTC ATTCTTTCAA TTGCGGAGGC
       GTTCTTTGAC TTCCTTATGA AGGGAGTGTT TTTGTAGTGG AAAGTCGGTA GTTCGCCGCC CCTGGACCTC TAATGTTGAG TAAGAAAGTT AACGCCTCCG
       EcoRI
       ~~~~~~
       E  F  F  Y   C  N  T   S  S  L   F  N  R  T   Y  M  A   N  S  T   D  M  A  N   S  T  E   T  N  S   T  R  T  I·
1101   GAATTCTTTT ACTGTAACAC CTCCTCTCTG TTTAATCGCA CATATATGGC TAACAGTACT GATATGGCAA ACTCTACTGA GACCAATAGT ACACGAACTA
       CTTAAGAAAA TGACATTGTG GAGGAGAGAC AAATTAGCGT GTATATACCG ATTGTCATGA CTATACCGTT TGAGATGACT CTGGTTATCA TGTGCTTGAT
```

Figure 24A cont.

```
     · T  I  H   C  R  I   K  Q  I   I  N  M   W  Q  E   V  G  R   A  M  Y   A  P  P   I  A  G   N  I  T   C  I  S ·
1201   TTACCATCCA TTGCCGGATC AAGCAGATTA TCAACATGTG GCAGGAAGTG GGGCGGGCCA TGTATGCTCC CCCTATTGCA GGAAATATTA CCTGTATCAG
       AATGGTAGGT AACGGCCTAG TTCGTCTAAT AGTTGTACAC CGTCCTTCAC CCCGCCCGGT ACATACGAGG GGGATAACGT CCTTTATAAT GGACATAGTC

     ·N  I  T   G  L  L  L   T  R  D   G  G  K   N  N  T  E   T  F  R   P  G  G   G  N  M  K   D  N  W   R  S  E
1301   CAACATTACC GGCCTGCTGC TGACAAGAGA CGGGGGAAAG AACAATACAG AGACTTTTAG GCCTGGCGGG GGAAACATGA AAGATAATTG GCGCTCCGAG
       GTTGTAATGG CCGGACGACG ACTGTTCTCT GCCCCCTTTC TTGTTATGTC TCTGAAAATC CGGACCGCCC CCTTTGTACT TTCTATTAAC CGCGAGGCTC

      L  Y  K  Y   K  V  V   K  I  E   P  L  G  V   A  P  T   R  C  K   R  R  V  V   G  R  R   R  R  R   R  A  V  G ·
1401   CTGTACAAGT ATAAAGTGGT CAAGATCGAA CCACTGGGAG TGGCACCTAC CCGATGTAAA CGGAGAGTGG TCGGAAGGCG CCGACGGAGA AGGGCAGTGG
       GACATGTTCA TATTTCACCA GTTCTAGCTT GGTGACCCTC ACCGTGGATG GGCTACATTT GCCTCTCACC AGCCTTCCGC GGCTGCCTCT TCCCGTCACC

     · I  G  A   V  F  L   G  F  L  G   A  A  G   S  T  M   G  A  A  S   M  T  L   T  V  Q   A  R  N  L   L  S  G ·
1501   GAATCGGAGC CGTCTTCCTG GGCTTTCTGG GAGCAGCTGG CAGCACAATG GGAGCAGCCT CTATGACCCT GACAGTGCAG GCTCGAAATC TGCTGAGTGG
       CTTAGCCTCG GCAGAAGGAC CCGAAAGACC CTCGTCGACC GTCGTGTTAC CCTCGTCGGA GATACTGGGA CTGTCACGTC CGAGCTTTAG ACGACTCACC

                                                                                                      PstI
                                                                                                    ~~~~~~~
     ·I  V  Q   Q  Q  S  N   L  L  R   A  P  E   A  Q  Q  H   L  L  K   L  T  V   W  G  I  K   Q  L  Q   A  R  V
1601   GATCGTGCAG CAGCAGTCAA ACCTGCTGCG AGCACCAGAG GCACAGCAGC ATCTGCTGAA GCTGACCGTG TGGGGCATCA AGCAGCTGCA GGCCAGAGTG
       CTAGCACGTC GTCGTCAGTT TGGACGACGC TCGTGGTCTC CGTGTCGTCG TAGACGACTT CGACTGGCAC ACCCCGTAGT TCGTCGACGT CCGGTCTCAC
```

Figure 24A cont.

```
     L  A  V  E  R  Y  L  R  D  Q  Q  L  L  G  I  W  G  C  S  G  K  L  I  C  C  T  N  V  P  W  N  S  S  W ·
1701 CTGGCTGTCG AACGGTACCT GAGAGATCAG CAGCTGCTGG GAATCTGGGG ATGCAGCGGA AAGCTGATTT GCTGTACAAA CGTGCCCTGG AATAGTTCAT
     GACCGACAGC TTGCCATGGA CTCTCTAGTC GTCGACGACC CTTAGACCCC TACGTCGCCT TTCGACTAAA CGACATGTTT GCACGGGACC TTATCAAGTA
                                                  PstI
                                                ~~~~~~~
     · S  N  R  N  L  S  E  I  W  D  N  M  T  W  L  Q  W  D  K  E  I  S  N  Y  T  Q  I  I  Y  G  L  L  E ·
1801 GGTCAAACAG GAATCTGAGC GAGATCTGGG ACAATATGAC CTGGCTGCAG TGGGATAAGG AAATCAGTAA CTACACACAG ATCATCTATG GCCTGCTGGA
     CCAGTTTGTC CTTAGACTCG CTCTAGACCC TGTTATACTG GACCGACGTC ACCCTATTCC TTTAGTCATT GATGTGTGTC TAGTAGATAC CGGACGACCT
     · E  S  Q  N  Q  Q  E  K  N  E  Q  D  L  L  A  L  D  *  L  K  W  A  S  L  W  N  W  F  D  I  S  N  W
1901 GGAATCACAG AACCAGCAGG AGAAAAATGA ACAGGACCTG CTGGCCCTGG ATTGACTAAA GTGGGCAAGT CTGTGGAATT GGTTTGACAT ATCAAACTGG
     CCTTAGTGTC TTGGTCGTCC TCTTTTTACT TGTCCTGGAC GACCGGGACC TAACTGATTT CACCCGTTCA GACACCTTAA CCAAACTGTA TAGTTTGACC
     L  W  Y  I  K  I  F  I  M  I  V  G  G  L  I  G  L  R  I  V  F  A  V  L  S  V  I  H  R  V  R  Q  G  Y ·
2001 CTGTGGTATA TAAAAATATT TATAATGATA GTAGGAGGCT TAATAGGATT AAGAATAGTT TTTGCTGTGC TTTCTGTAAT ACATAGAGTT AGGCAGGGAT
     GACACCATAT ATTTTTATAA ATATTACTAT CATCCTCCGA ATTATCCTAA TTCTTATCAA AAACGACACG AAAGACATTA TGTATCTCAA TCCGTCCCTA
     · S  P  L  S  F  Q  T  H  T  P  N  P  R  G  L  D  R  P  E  R  I  E  E  E  D  G  E  Q  D  R  G  R  S ·
2101 ACTCACCTTT GTCGTTTCAG ACCCATACCC CAAACCCAAG GGGACTCGAC AGGCCCGAAA GAATCGAAGA AGAAGATGGA GAGCAAGACA GAGGCAGATC
     TGAGTGGAAA CAGCAAAGTC TGGGTATGGG GTTTGGGTTC CCCTGAGCTG TCCGGGCTTT CTTAGCTTCT TCTTCTACCT CTCGTTCTGT CTCCGTCTAG
     · T  R  L  V  S  G  F  L  A  L  A  W  D  D  L  R  S  L  C  L  F  C  Y  H  R  L  R  D  F  I  L  I  A
2201 GACGCGATTA GTGAGCGGAT TCTTAGCTCT TGCCTGGGAC GATCTGAGGA GCCTGTGCCT CTTCTGCTAC CACCGATTGA GAGACTTCAT CTTGATTGCA
     CTGCGCTAAT CACTCGCCTA AGAATCGAGA ACGGACCCTG CTAGACTCCT CGGACACGGA GAAGACGATG GTGGCTAACT CTCTGAAGTA GAACTAACGT
```

Figure 24A cont.

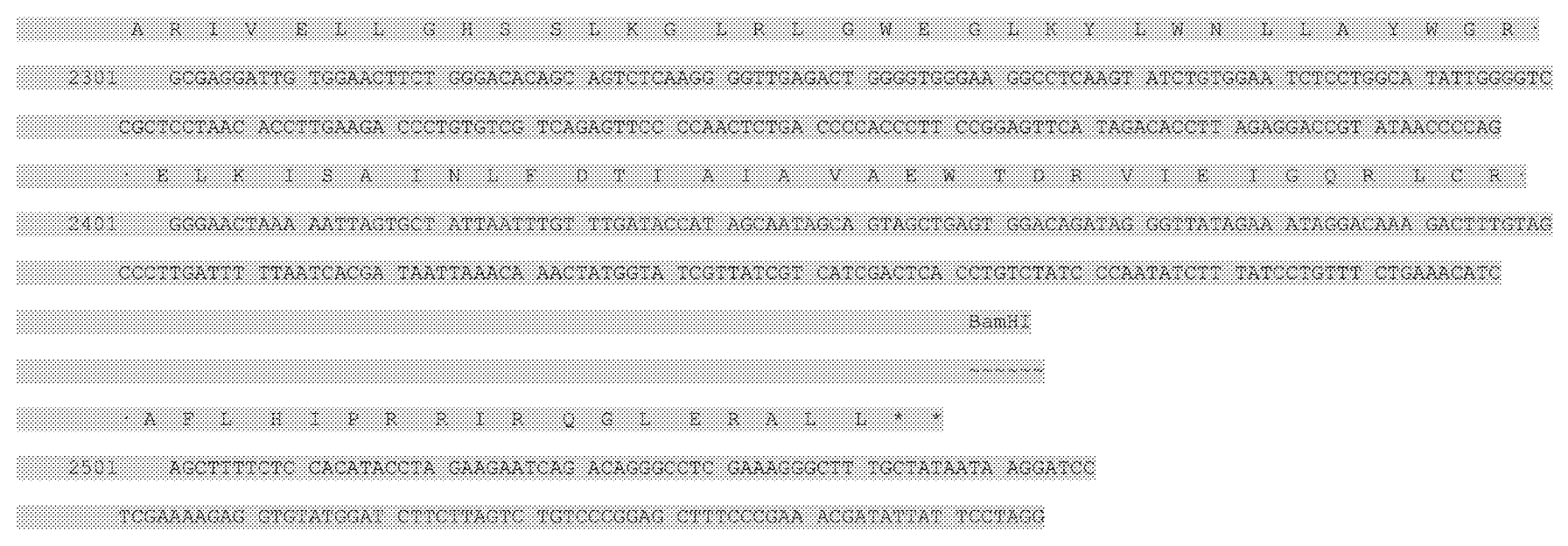

```
      A  R  I  V   E  L  L   G  H  S   S  L  K  G   L  R  L   G  W  E   G  L  K  Y   L  W  N   L  L  A   Y  W  G  R ·
2301    GCGAGGATTG TGGAACTTCT GGGACACAGC AGTCTCAAGG GGTTGAGACT GGGGTGGGAA GGCCTCAAGT ATCTGTGGAA TCTCCTGGCA TATTGGGGTC
        CGCTCCTAAC ACCTTGAAGA CCCTGTGTCG TCAGAGTTCC CCAACTCTGA CCCCACCCTT CCGGAGTTCA TAGACACCTT AGAGGACCGT ATAACCCCAG
      · E  L  K   I  S  A   I  N  L  F   D  T  I   A  I  A   V  A  E  W   T  D  R   V  I  E   I  G  Q  R   L  C  R ·
2401    GGGAACTAAA AATTAGTGCT ATTAATTTGT TTGATACCAT AGCAATAGCA GTAGCTGAGT GGACAGATAG GGTTATAGAA ATAGGACAAA GACTTTGTAG
        CCCTTGATTT TTAATCACGA TAATTAAACA AACTATGGTA TCGTTATCGT CATCGACTCA CCTGTCTATC CCAATATCTT TATCCTGTTT CTGAAACATC
                                                                              BamHI
                                                                              ~~~~~~
      ·A  F  L   H  I  P  R   R  I  R   Q  G  L   E  R  A   L   L  *  *
2501    AGCTTTTCTC CACATACCTA GAAGAATCAG ACAGGGCCTC GAAAGGCTTT TGCTATAATA AGGATCC
        TCGAAAAGAG GTGTATGGAT CTTCTTAGTC TGTCCCGGAG CTTTCCGAAA ACGATATTAT TCCTAGG
```

Figure 24A cont.

CH505TF chimera SOSIP.664.v4.1AMber stopCTAG (SEQ ID NO. 295)

Add CTAG GC (Leu Gly) after the amber stop codon UGA

```
  1MPMGSLQPLA TLYLLGMLVA SVLAAENLWV TVYYGVPVWK EAKTTLFCAS
 51  DAKAYEKKVH NVWATHACVP TDPNPQEMVL KNVTENFNMW KNDMVDQMHE
101  DVISLWDQSL KPCVKLTPLC VTLNCTNATA SNSSIIEGMK NCSFNITTEL
151  RDKREKKNAL FYKLDIVQLD GNSSQYRLIN CNTSVITQAC PKVSFDPIPI
201  HYCAPAGYAI LKCNNKTFTG TGPCNNVSTV QCTHGIKPVV STQLLLNGSL
251  AEGEIIIRSE NITNNVKTII VHLNESVKIE CTRPNNKTRT SIRIGPGQWF
301  YATGQVIGDI REAYCNINES KWNETLQRVS KKLKEYFPHK NITFQPSSGG
351  DLEITTHSFN CGGEFFYCNT SSLFNRTYMA NSTDMANSTE TNSTRTITIH
401  CRIKQIINMW QEVGRAMYAP PIAGNITCIS NITGLLLTRD GGKNNTETFR
451  PGGGNMKDNW RSELYKYKVV KIEPLGVAPT RCKRRVVGRR RRRRAVGIGA
501  VFLGFLGAAG STMGAASMTL TVQARNLLSG IVQQQSNLLR APEAQQHLLK
551  LTVWGIKQLQ ARVLAVERYL RDQQLLGIWG CSGKLICCTN VPWNSSWSNR
601  NLSEIWDNMT WLQWDKEISN YTQIIYGLLE ESQNQQEKNE QDLLALD*LG
651  KWASLWNWFD ISNWLWYIKI FIMIVGGLIG LRIVFAVLSV IHRVRQGYSP
701  LSFQTHTPNP RGLDRPERIE EEDGEQDRGR STRLVSGFLA LAWDDLRSLC
751  LFCYHRLRDF ILIAARIVEL LGHSSLKGLR LGWEGLKYLW NLLAYWGREL
801  KISAINLFDT IAIAVAEWTD RVIEIGQRLC RAFLHIPRRI RQGLERALL*
851  *
```

Figure 24A cont.

CH505TF chimera SOSIP.664.v4.1AMber stopCTA (SEQ ID NO. 296)

Add CTA (Leu) after the amber stop codon UGA

```
  1 MPMGSLQPLA TLYLLGMLVA SVLAAENLWV TVYYGVPVWK EAKTTLFCAS
 51 DAKAYEKKVH NVWATHACVP TDPNPQEMVL KNVTENFNMW KNDMVDQMHE
101 DVISLWDQSL KPCVKLTPLC VTLNCTNATA SNSSIIEGMK NCSFNITTEL
151 RDKREKKNAL FYKLDIVQLD GNSSQYRLIN CNTSVITQAC PKVSFDPIPI
201 HYCAPAGYAI LKCNNKTFTG TGPCNNVSTV QCTHGIKPVV STQLLLNGSL
251 AEGEIIIRSE NITNNVKTII VHLNESVKIE CTRPNNKTRT SIRIGPGQWF
301 YATGQVIGDI REAYCNINES KWNETLQRVS KKLKEYFPHK NITFQPSSGG
351 DLEITTHSFN CGGEFFYCNT SSLFNRTYMA NSTDMANSTE TNSTRTITIH
401 CRIKQIINMW QEVGRAMYAP PIAGNITCIS NITGLLLTRD GGKNNTETFR
451 PGGGNMKDNW RSELYKYKVV KIEPLGVAPT RCKRRVVGRR RRRRAVGIGA
501 VFLGFLGAAG STMGAASMTL TVQARNLLSG IVQQQSNLLR APEAQQHLLK
551 LTVWGIKQLQ ARVLAVERYL RDQQLLGIWG CSGKLICCTN VPWNSSWSNR
601 NLSEIWDNMT WLQWDKEISN YTQIIYGLLE ESQNQQEKNE QDLLALD*LK
651 WASLWNWFDI SNWLWYIKIF IMIVGGLIGL RIVFAVLSVI HRVRQGYSPL
701 SFQTHTPNPR GLDRPERIEE EDGEQDRGRS TRLVSGFLAL AWDDLRSLCL
751 FCYHRLRDFI LIAARIVELL GHSSLKGLRL GWEGLKYLWN LLAYWGRELK
801 ISAINLFDTI AIAVAEWTDR VIEIGQRLCR AFLHIPRRIR QGLERALL**
```

Figure 24A cont.

>CH505TF chimera SOSIP.664.v4.1 C-SORTA (HV1301189_C_SORTAv2) (SEQ ID NO. 297)

ATGCCCATGGGCAGCCTGCAGCCCCTGGCCACCCTGTACCTGCTGGGCATGCTGGTGGCTAGCGTGCTGGC
CGCCGAGAACCTGTGGGTGACCGTCTACTATGGCGTGCCCGTCTGGAAGGAAGCCAAAACCACACTGTTCT
GCGCTAGCGACGCTAAGGCATACGAGAAAAAAGTGCACAATGTCTGGGCTACTCATGCATGCGTGCCTAC
CGATCCAAATCCCCAGGAGATGGTGCTGAAGAACGTCACAGAAAACTTTAATATGTGGAAGAACGACATG
GTGGATCAGATGCACGAGGACGTGATCAGCCTGTGGGATCAGTCCCTGAAGCCATGCGTGAAACTGACTC
CCCTGTGCGTCACCCTGAACTGTACTAATGCCACCGCTTCCAACAGCTCCATCATTGAGGGGATGAAGAACT
GTTCTTTCAATATCACTACCGAGCTGCGCGACAAGCGAGAAAAGAAAAATGCCCTGTTTTACAAACTGGAC
ATCGTGCAGCTGGATGGCAACTCTAGTCAGTATAGACTGATTAACTGCAATACAAGCGTGATCACTCAGGC
ATGTCCAAAGGTCAGTTTCGATCCTATTCCAATCCACTACTGCGCACCCGCCGGATATGCTATCCTGAAGTG
TAACAACAAGACCTTCACCGGCACTGGGCCTTGCAACAACGTGAGCACCGTCCAGTGTACACATGGCATTA
AGCCAGTGGTCAGCACCCAGCTGCTGCTGAACGGCAGCCTGGCAGAGGGCGAAATCATTATCCGCAGCGA
GAACATCACAAATAATGTGAAGACTATCATCGTCCACCTGAACGAGAGCGTGAAGATTGAATGCACACGGC
CCAACAACAAGACCAGGACATCCATTCGCATCGGACCTGGCCAGTGGTTCTACGCTACTGGCCAGGTCATC
GGGGACATCAGAGAGGCCTATTGTAACATCAATGAGTCAAAGTGGAATGAAACTCTGCAGAGGGTGAGCA
AGAAACTGAAGGAATACTTCCCTCACAAAAACATCACCTTTCAGCCATCAAGCGGCGGGGACCTGGAGATT
ACAACTCATTCTTTCAATTGCGGAGGCGAATTCTTTTACTGTAACACCTCCTCTCTGTTTAATCGCACATATAT
GGCTAACAGTACTGATATGGCAAACTCTACTGAGACCAATAGTACACGAACTATTACCATCCATTGCCGGAT
CAAGCAGATTATCAACATGTGGCAGGAAGTGGGGCGGGCCATGTATGCTCCCCCTATTGCAGGAAATATTA
CCTGTATCAGCAACATTACCGGCCTGCTGCTGACAAGAGACGGGGGAAAGAACAATACAGAGACTTTTAG
GCCTGGCGGGGGAAACATGAAAGATAATTGGCGCTCCGAGCTGTACAAGTATAAAGTGGTCAAGATCGAA
CCACTGGGAGTGGCACCTACCCGATGTAAACGGAGAGTGGTCGGAAGGCGCCGACGGAGAAGGGCAGTG
GGAATCGGAGCCGTCTTCCTGGGCTTTCTGGGAGCAGCTGGCAGCACAATGGGAGCAGCCTCTATGACCCT
GACAGTGCAGGCTCGAAATCTGCTGAGTGGGATCGTGCAGCAGCAGTCAAACCTGCTGCGAGCACCAGAG
GCACAGCAGCATCTGCTGAAGCTGACCGTGTGGGGCATCAAGCAGCTGCAGGCCAGAGTGCTGGCTGTCG
AACGGTACCTGAGAGATCAGCAGCTGCTGGGAATCTGGGGATGCAGCGGAAAGCTGATTTGCTGTACAAA
CGTGCCCTGGAATAGTTCATGGTCAAACAGGAATCTGAGCGAGATCTGGGACAATATGACCTGGCTGCAG
TGGGATAAGGAAATCAGTAACTACACACAGATCATCTATGGCCTGCTGGAGGAATCACAGAACCAGCAGG
AGAAAAATGAACAGGACCTGCTGGCCCTGGATCTGCCTAGCACCGGATGATGA

Figure 24B

>CH505TF.6R.SOSIP.664.v4.1_N_SORTA (HV1301189_N-SORTA) (SEQ ID NO. 298)

ATGCCCATGGGCAGCCTGCAGCCCCTGGCCACCCTGTACCTGCTGGGCATGCTGGTGGCTAGCGTGCTGGCCGGCGG
GGGCGGGGGCGGCGGGGGCGGGGGCGGCGGGGGCGGGGGCGCCGAGAACCTGTGGGTGACCGTCTACTATGGC
GTGCCCGTCTGGAAGGAAGCCAAAACCACACTGTTCTGCGCTAGCGACGCTAAGGCATACGAGAAAAAAGTGCACA
ATGTCTGGGCTACTCATGCATGCGTGCCTACCGATCCAAATCCCCAGGAGATGGTGCTGAAGAACGTCACAGAAAAC
TTTAATATGTGGAAGAACGACATGGTGGATCAGATGCACGAGGACGTGATCAGCCTGTGGGATCAGTCCCTGAAGCC
ATGCGTGAAACTGACTCCCCTGTGCGTCACCCTGAACTGTACTAATGCCACCGCTTCCAACAGCTCCATCATTGAGGG
GATGAAGAACTGTTCTTTCAATATCACTACCGAGCTGCGCGACAAGCGAGAAAAGAAAAATGCCCTGTTTTACAAACT
GGACATCGTGCAGCTGGATGGCAACTCTAGTCAGTATAGACTGATTAACTGCAATACAAGCGTGATCACTCAGGCAT
GTCCAAAGGTCAGTTTCGATCCTATTCCAATCCACTACTGCGCACCCGCCGGATATGCTATCCTGAAGTGTAACAACAA
GACCTTCACCGGCACTGGGCCTTGCAACAACGTGAGCACCGTCCAGTGTACACATGGCATTAAGCCAGTGGTCAGCA
CCCAGCTGCTGCTGAACGGCAGCCTGGCAGAGGGCGAAATCATTATCCGCAGCGAGAACATCACAAATAATGTGAAG
ACTATCATCGTCCACCTGAACGAGAGCGTGAAGATTGAATGCACACGGCCCAACAACAAGACCAGGACATCCATTCG
CATCGGACCTGGCCAGTGGTTCTACGCTACTGGCCAGGTCATCGGGGACATCAGAGAGGCCTATTGTAACATCAATG
AGTCAAAGTGGAATGAAACTCTGCAGAGGGTGAGCAAGAAACTGAAGGAATACTTCCCTCACAAAAACATCACCTTT
CAGCCATCAAGCGGCGGGGACCTGGAGATTACAACTCATTCTTTCAATTGCGGAGGCGAATTCTTTTACTGTAACACC
TCCTCTCTGTTTAATCGCACATATATGGCTAACAGTACTGATATGGCAAACTCTACTGAGACCAATAGTACACGAACTA
TTACCATCCATTGCCGGATCAAGCAGATTATCAACATGTGGCAGGAAGTGGGGCGGGCCATGTATGCTCCCCCTATTG
CAGGAAATATTACCTGTATCAGCAACATTACCGGCCTGCTGCTGACAAGAGACGGGGGAAAGAACAATACAGAGACT
TTTAGGCCTGGCGGGGGAAACATGAAAGATAATTGGCGCTCCGAGCTGTACAAGTATAAAGTGGTCAAGATCGAAC
CACTGGGAGTGGCACCTACCCGATGTAAACGGAGAGTGGTCGGAAGGCGCCGACGGAGAAGGGCAGTGGGAATCG
GAGCCGTCTTCCTGGGCTTTCTGGGAGCAGCTGGCAGCACAATGGGAGCAGCCTCTATGACCCTGACAGTGCAGGCT
CGAAATCTGCTGAGTGGGATCGTGCAGCAGCAGTCAAACCTGCTGCGAGCACCAGAGGCACAGCAGCATCTGCTGA
AGCTGACCGTGTGGGGCATCAAGCAGCTGCAGGCCAGAGTGCTGGCTGTCGAACGGTACCTGAGAGATCAGCAGCT
GCTGGGAATCTGGGGATGCAGCGGAAAGCTGATTTGCTGTACAAACGTGCCCTGGAATAGTTCATGGTCAAACAGG
AATCTGAGCGAGATCTGGGACAATATGACCTGGCTGCAGTGGGATAAGGAAATCAGTAACTACACACAGATCATCTA
TGGCCTGCTGGAGGAATCACAGAACCAGCAGGAGAAAAATGAACAGGACCTGCTGGCCCTGGATTGATGA

Figure 24B cont.

>CH505M5chim.6R.SOSIP.664v4.1_N_SORTA (SEQ ID NO. 299)

ATGCCCATGGGCTCCCTGCAGCCCCTGGCCACCCTGTACCTGCTGGGCATGCTGGTGGCCTCCGTG
CTGGCCGGCGGGGGCGGGGGCGGCGGGGGCGGGGGCGGCGGGGGCGGGGGCGCCGAGAACCTGTGG
GTGACCGTGTACTACGGCGTGCCCGTGTGGAAGGAGGCCAAGACCACCCTGTTCTGCGCCTCCGAC
GCCAAGGCCTACGAGAAGAAGGTGCACAACGTGTGGGCCACCCACGCCTGCGTGCCCACCGACCCC
AACCCCCAGGAGATGGTGCTGAAGAACGTGACCGAGAACTTCAACATGTGGAAGAACGACATGGTG
GACCAGATGCACGAGGACGTGATCTCCCTGTGGGACCAGTCCCTGAAGCCCTGCGTGAAGCTGACC
CCCCTGTGCGTGACCCTGAACTGCACCAACGCCACCGCCTCCAACTCCTCCATCATCGAGGGCATG
AAGAACTGCTCCTTCAACATCACCACCGAGCTGCGCGACAAGCGCGAGAAGAAGAACGCCCTGTTC
TACAAGCTGGACATCGTGCAGCTGGACGGCAACTCCTCCCAGTACCGCCTGATCAACTGCAACACC
TCCGTGATCACCCAGGCCTGCCCCAAGGTGTCCTTCGACCCCATCCCCATCCACTACTGCGCCCCC
GCCGGCTACGCCATCCTGAAGTGCAACAACAAGACCTTCACCGGCACCGGCCCCTGCAACAACGTG
TCCACCGTGCAGTGCACCCACGGCATCAAGCCCGTGGTGTCCACCCAGCTGCTGCTGAACGGCTCC
CTGGCCGAGGGCGAGATCATCATCCGCTCCGAGAACATCACCAAGAACGTGAAGACCATCATCGTG
CACCTGAACGAGTCCGTGAAGATCGAGTGCACCCGCCCCAACAACAAGACCCGCACCTCCATCCGC
ATCGGCCCCGGCCAGTGGTTCTACGCCACCGGCCAGGTGATCGGCGACATCCGCGAGGCCTACTGC
AACATCAACGAGTCCAAGTGGAACGAGACCCTGCAGCGCGTGTCCAAGAAGCTGAAGGAGTACTTC
CCCCACAAGAACATCACCTTCCAGCCCTCCTCCGGCGGCGACCTGGAGATCACCACCCACTCCTTC
AACTGCGGCGGCGAGTTCTTCTACTGCAACACCTCCTCCCTGTTCAACCGCACCTACATGGCCAAC
TCCACCGACATGGCCAACTCCACCGAGACCAACTCCACCCGCACCATCACCATCCACTGCCGCATC
AAGCAGATCATCAACATGTGGCAGGAGGTGGGCCGCGCCATGTACGCCCCCCCCATCGCCGGCAAC
ATCACCTGCATCTCCAACATCACCGGCCTGCTGCTGACCCGCGACGGCGGCAAGAACAACACCGAG
ACCTTCCGCCCCGGCGGCGGCAACATGAAGGACAACTGGCGCTCCGAGCTGTACAAGTACAAGGTG
GTGAAGATCGAGCCCCTGGGCGTGGCCCCCACCCGCTGCAAGCGCCGCGTGGTGGGCCGCCGCCGC
CGCCGCCGCGCCGTGGGCATCGGCGCCGTGTTCCTGGGCTTCCTGGGCGCCGCCGGCTCCACCATG
GGCGCCGCCTCCATGACCCTGACCGTGCAGGCCCGCAACCTGCTGTCCGGCATCGTGCAGCAGCAG
TCCAACCTGCTGCGCGCCCCCGAGGCCCAGCAGCACCTGCTGAAGCTGACCGTGTGGGGCATCAAG
CAGCTGCAGGCCCGCGTGCTGGCCGTGGAGCGCTACCTGCGCGACCAGCAGCTGCTGGGCATCTGG
GGCTGCTCCGGCAAGCTGATCTGCTGCACCAACGTGCCCTGGAACTCCTCCTGGTCCAACCGCAAC
CTGTCCGAGATCTGGGACAACATGACCTGGCTGCAGTGGGACAAGGAGATCTCCAACTACACCCAG
ATCATCTACGGCCTGCTGGAGGAGTCCCAGAACCAGCAGGAGAAGAACGAGCAGGACCTGCTGGCC
CTGGACTAG

Figure 24B cont.

>CH505M5chim.6R.SOSIP.664v4.1_N_SORTA (SEQ ID NO. 300)

MPMGSLQPLATLYLLGMLVASVLAGGGGGGGGGGGGGGGAENLWVTVYYGVPVWKEAKTTLFCASD
AKAYEKKVHNVWATHACVPTDPNPQEMVLKNVTENFNMWKNDMVDQMHEDVISLWDQSLKPCVKLT
PLCVTLNCTNATASNSSIIEGMKNCSFNITTELRDKREKKNALFYKLDIVQLDGNSSQYRLINCNT
SVITQACPKVSFDPIPIHYCAPAGYAILKCNNKTFTGTGPCNNVSTVQCTHGIKPVVSTQLLLNGS
LAEGEIIIRSENITKNVKTIIVHLNESVKIECTRPNNKTRTSIRIGPGQWFYATGQVIGDIREAYC
NINESKWNETLQRVSKKLKEYFPHKNITFQPSSGGDLEITTHSFNCGGEFFYCNTSSLFNRTYMAN
STDMANSTETNSTRTITIHCRIKQIINMWQEVGRAMYAPPIAGNITCISNITGLLLTRDGGKNNTE
TFRPGGGNMKDNWRSELYKYKVVKIEPLGVAPTRCKRRVVGRRRRRRAVGIGAVFLGFLGAAGSTM
GAASMTLTVQARNLLSGIVQQQSNLLRAPEAQQHLLKLTVWGIKQLQARVLAVERYLRDQQLLGIW
GCSGKLICCTNVPWNSSWSNRNLSEIWDNMTWLQWDKEISNYTQIIYGLLEESQNQQEKNEQDLLA
LD*

>CH505M5chim.6R.SOSIP.664v4.1_C_SORTA (SEQ ID NO. 301)

ATGCCCATGGGCTCCCTGCAGCCCCTGGCCACCCTGTACCTGCTGGGCATGCTGGTGGCCTCCGTG
CTGGCCGCCGAGAACCTGTGGGTGACCGTGTACTACGGCGTGCCCGTGTGGAAGGAGGCCAAGACC
ACCCTGTTCTGCGCCTCCGACGCCAAGGCCTACGAGAAGAAGGTGCACAACGTGTGGGCCACCCAC
GCCTGCGTGCCCACCGACCCCAACCCCCAGGAGATGGTGCTGAAGAACGTGACCGAGAACTTCAAC
ATGTGGAAGAACGACATGGTGGACCAGATGCACGAGGACGTGATCTCCCTGTGGGACCAGTCCCTG
AAGCCCTGCGTGAAGCTGACCCCCCTGTGCGTGACCCTGAACTGCACCAACGCCACCGCCTCCAAC
TCCTCCATCATCGAGGGCATGAAGAACTGCTCCTTCAACATCACCACCGAGCTGCGCGACAAGCGC
GAGAAGAAGAACGCCCTGTTCTACAAGCTGGACATCGTGCAGCTGGACGGCAACTCCTCCCAGTAC
CGCCTGATCAACTGCAACACCTCCGTGATCACCCAGGCCTGCCCCAAGGTGTCCTTCGACCCCATC
CCCATCCACTACTGCGCCCCCGCCGGCTACGCCATCCTGAAGTGCAACAACAAGACCTTCACCGGC
ACCGGCCCCTGCAACAACGTGTCCACCGTGCAGTGCACCCACGGCATCAAGCCCGTGGTGTCCACC
CAGCTGCTGCTGAACGGCTCCCTGGCCGAGGGCGAGATCATCATCCGCTCCGAGAACATCACCAAG
AACGTGAAGACCATCATCGTGCACCTGAACGAGTCCGTGAAGATCGAGTGCACCCGCCCCAACAAC
AAGACCCGCACCTCCATCCGCATCGGCCCCGGCCAGTGGTTCTACGCCACCGGCCAGGTGATCGGC
GACATCCGCGAGGCCTACTGCAACATCAACGAGTCCAAGTGGAACGAGACCCTGCAGCGCGTGTCC
AAGAAGCTGAAGGAGTACTTCCCCCACAAGAACATCACCTTCCAGCCCTCCTCCGGCGGCGACCTG
GAGATCACCACCCACTCCTTCAACTGCGGCGGCGAGTTCTTCTACTGCAACACCTCCTCCCTGTTC
AACCGCACCTACATGGCCAACTCCACCGACATGGCCAACTCCACCGAGACCAACTCCACCCGCACC
ATCACCATCCACTGCCGCATCAAGCAGATCATCAACATGTGGCAGGAGGTGGGCCGCGCCATGTAC
GCCCCCCCCATCGCCGGCAACATCACCTGCATCTCCAACATCACCGGCCTGCTGCTGACCCGCGAC
GGCGGCAAGAACAACACCGAGACCTTCCGCCCCGGCGGCGGCAACATGAAGGACAACTGGCGCTCC
GAGCTGTACAAGTACAAGGTGGTGAAGATCGAGCCCCTGGGCGTGGCCCCCACCCGCTGCAAGCGC
CGCGTGGTGGGCCGCCGCCGCCGCCGCCGCGCCGTGGGCATCGGCGCCGTGTTCCTGGGCTTCCTG
GGCGCCGCCGGCTCCACCATGGGCGCCGCCTCCATGACCCTGACCGTGCAGGCCCGCAACCTGCTG
TCCGGCATCGTGCAGCAGCAGTCCAACCTGCTGCGCGCCCCCGAGGCCCAGCAGCACCTGCTGAAG
CTGACCGTGTGGGGCATCAAGCAGCTGCAGGCCCGCGTGCTGGCCGTGGAGCGCTACCTGCGCGAC
CAGCAGCTGCTGGGCATCTGGGGCTGCTCCGGCAAGCTGATCTGCTGCACCAACGTGCCCTGGAAC
TCCTCCTGGTCCAACCGCAACCTGTCCGAGATCTGGGACAACATGACCTGGCTGCAGTGGGACAAG
GAGATCTCCAACTACACCCAGATCATCTACGGCCTGCTGGAGGAGTCCCAGAACCAGCAGGAGAAG
AACGAGCAGGACCTGCTGGCCCTGGACCTGCCTAGCACCGGATAG

Figure 24B cont.

>CH505M5chim.6R.SOSIP.664v4.1_C_SORTA (SEQ ID NO. 302)

MPMGSLQPLATLYLLGMLVASVLAAENLWVTVYYGVPVWKEAKTTLFCASDAKAYEKKVHNVWATH
ACVPTDPNPQEMVLKNVTENFNMWKNDMVDQMHEDVISLWDQSLKPCVKLTPLCVTLNCTNATASN
SSIIEGMKNCSFNITTELRDKREKKNALFYKLDIVQLDGNSSQYRLINCNTSVITQACPKVSFDPI
PIHYCAPAGYAILKCNNKTFTGTGPCNNVSTVQCTHGIKPVVSTQLLLNGSLAEGEIIIRSENITK
NVKTIIVHLNESVKIECTRPNNKTRTSIRIGPGQWFYATGQVIGDIREAYCNINESKWNETLQRVS
KKLKEYFPHKNITFQPSSGGDLEITTHSFNCGGEFFYCNTSSLFNRTYMANSTDMANSTETNSTRT
ITIHCRIKQIINMWQEVGRAMYAPPIAGNITCISNITGLLLTRDGGKNNTETFRPGGGNMKDNWRS
ELYKYKVVKIEPLGVAPTRCKRRVVGRRRRRRAVGIGAVFLGFLGAAGSTMGAASMTLTVQARNLL
SGIVQQQSNLLRAPEAQQHLLKLTVWGIKQLQARVLAVERYLRDQQLLGIWGCSGKLICCTNVPWN
SSWSNRNLSEIWDNMTWLQWDKEISNYTQIIYGLLEESQNQQEKNEQDLLALDLPSTG*

Figure 24B cont.

CH505 Ferritin constructs

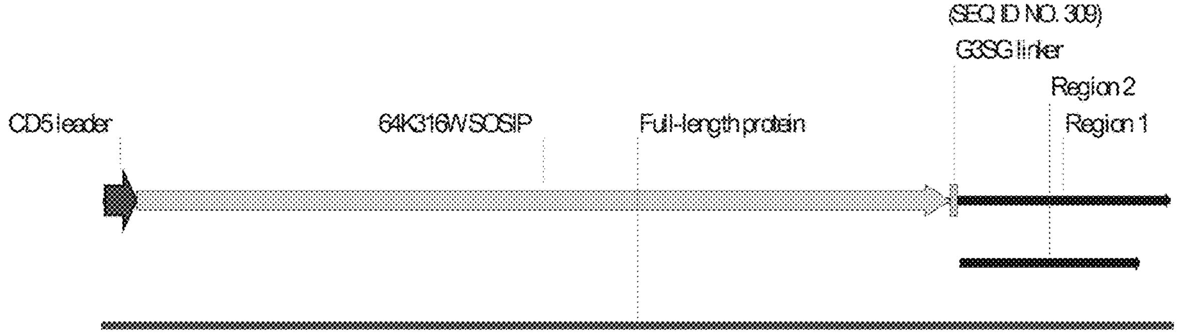

CH505TFchimv4.1-ferritin
815 aa

>CH505TFchimv4.1-ferritin (signal peptide; ferritin, *glycine linker*) (SEQ ID NO. 310)

```
MPMGSLQPLA TLYLLGMLVA SVLAAENLWV TVYYGVPVWK EAKTTLFCAS
DAKAYEKKVH NVWATHACVP TDPNPQEMVL KNVTENFNMW KNDMVDQMHE
DVISLWDQSL KPCVKLTPLC VTLNCTNATA SNSSIIEGMK NCSFNITTEL
RDKREKKNAL FYKLDIVQLD GNSSQYRLIN CNTSVITQAC PKVSFDPIPI
HYCAPAGYAI LKCNNKTFTG TGPCNNVSTV QCTHGIKPVV STQLLLNGSL
AEGEIIIRSE NITNNVKTII VHLNESVKIE CTRPNNKTRT SIRIGPGQWF
YATGQVIGDI REAYCNINES KWNETLQRVS KKLKEYFPHK NITFQPSSGG
DLEITTHSFN CGGEFFYCNT SSLFNRTYMA NSTDMANSTE TNSTRTITIH
CRIKQIINMW QEVGRAMYAP PIAGNITCIS NITGLLLTRD GGKNNTETFR
PGGGNMKDNW RSELYKYKVV KIEPLGVAPT RCKRRVVGRR RRRRAVGIGA
VFLGFLGAAG STMGAASMTL TVQARNLLSG IVQQQSNLLR APEAQQHLLK
LTVWGIKQLQ ARVLAVERYL RDQQLLGIWG CSGKLICCTN VPWNSSWSNR
NLSEIWDNMT WLQWDKEISN YTQIIYGLLE ESQNQQEKNE QDLLALDGGG
SGDIIKLLNE QVNKEMNSSN LYMSMSSWCY THSLDGAGLF LFDHAAEEYE
HAKKLIIFLN ENNVPVQLTS ISAPEHKFEG LTQIFQKAYE HEQHISESIN
NIVDHAIKSK DHATFNFLQW YVAEQHEEEV LFKDILDKIE LIGNENHGLY
LADQYVKGIA KSRKS**
```

Figure 24G

>CH505TFchimv4.1-ferritin(HV1301350) (SEQ ID NO. 311)

ATGCCCATGGGCTCCCTGCAGCCCCTGGCCACCCTGTACCTGCTGGGCATGCTGGTGGCCTCCGTG
CTGGCCGCCGAGAACCTGTGGGTGACCGTGTACTACGGCGTGCCCGTGTGGAAGGAGGCCAAGACC
ACCCTGTTCTGCGCCTCCGACGCCAAGGCCTACGAGAAGAAGGTGCACAACGTGTGGGCCACCCAC
GCCTGCGTGCCCACCGACCCCAACCCCCAGGAGATGGTGCTGAAGAACGTGACCGAGAACTTCAAC
ATGTGGAAGAACGACATGGTGGACCAGATGCACGAGGACGTGATCTCCCTGTGGGACCAGTCCCTG
AAGCCCTGCGTGAAGCTGACCCCCCTGTGCGTGACCCTGAACTGCACCAACGCCACCGCCTCCAAC
TCCTCCATCATCGAGGGCATGAAGAACTGCTCCTTCAACATCACCACCGAGCTGCGCGACAAGCGC
GAGAAGAAGAACGCCCTGTTCTACAAGCTGGACATCGTGCAGCTGGACGGCAACTCCTCCCAGTAC
CGCCTGATCAACTGCAACACCTCCGTGATCACCCAGGCCTGCCCCAAGGTGTCCTTCGACCCCATC
CCCATCCACTACTGCGCCCCCGCCGGCTACGCCATCCTGAAGTGCAACAACAAGACCTTCACCGGC
ACCGGCCCCTGCAACAACGTGTCCACCGTGCAGTGCACCCACGGCATCAAGCCCGTGGTGTCCACC
CAGCTGCTGCTGAACGGCTCCCTGGCCGAGGGCGAGATCATCATCCGCTCCGAGAACATCACCAAC
AACGTGAAGACCATCATCGTGCACCTGAACGAGTCCGTGAAGATCGAGTGCACCCGCCCCAACAAC
AAGACCCGCACCTCCATCCGCATCGGCCCCGGCCAGTGGTTCTACGCCACCGGCCAGGTGATCGGC
GACATCCGCGAGGCCTACTGCAACATCAACGAGTCCAAGTGGAACGAGACCCTGCAGCGCGTGTCC
AAGAAGCTGAAGGAGTACTTCCCCCACAAGAACATCACCTTCCAGCCCTCCTCCGGCGGCGACCTG
GAGATCACCACCCACTCCTTCAACTGCGGCGGCGAGTTCTTCTACTGCAACACCTCCTCCCTGTTC
AACCGCACCTACATGGCCAACTCCACCGACATGGCCAACTCCACCGAGACCAACTCCACCCGCACC
ATCACCATCCACTGCCGCATCAAGCAGATCATCAACATGTGGCAGGAGGTGGGCCGCGCCATGTAC
GCCCCCCCCATCGCCGGCAACATCACCTGCATCTCCAACATCACCGGCCTGCTGCTGACCCGCGAC
GGCGGCAAGAACAACACCGAGACCTTCCGCCCCGGCGGCGGCAACATGAAGGACAACTGGCGCTCC
GAGCTGTACAAGTACAAGGTGGTGAAGATCGAGCCCCTGGGCGTGGCCCCCACCCGCTGCAAGCGC
CGCGTGGTGGGCCGCCGCCGCCGCCGCCGCGCCGTGGGCATCGGCGCCGTGTTCCTGGGCTTCCTG
GGCGCCGCCGGCTCCACCATGGGCGCCGCCTCCATGACCCTGACCGTGCAGGCCCGCAACCTGCTG
TCCGGCATCGTGCAGCAGCAGTCCAACCTGCTGCGCGCCCCCGAGGCCCAGCAGCACCTGCTGAAG
CTGACCGTGTGGGGCATCAAGCAGCTGCAGGCCCGCGTGCTGGCCGTGGAGCGCTACCTGCGCGAC
CAGCAGCTGCTGGGCATCTGGGGCTGCTCCGGCAAGCTGATCTGCTGCACCAACGTGCCCTGGAAC
TCCTCCTGGTCCAACCGCAACCTGTCCGAGATCTGGGACAACATGACCTGGCTGCAGTGGGACAAG
GAGATCTCCAACTACACCCAGATCATCTACGGCCTGCTGGAGGAGTCCCAGAACCAGCAGGAGAAG
AACGAGCAGGACCTGCTGGCCCTGGACGGCGGCGGCTCCGGCGACATCATCAAGCTGCTGAACGAG
CAGGTGAACAAGGAGATGAACTCCTCCAACCTGTACATGTCCATGTCCTCCTGGTGCTACACCCAC
TCCCTGGACGGCGCCGGCCTGTTCCTGTTCGACCACGCCGCCGAGGAGTACGAGCACGCCAAGAAG
CTGATCATCTTCCTGAACGAGAACAACGTGCCCGTGCAGCTGACCTCCATCTCCGCCCCCGAGCAC
AAGTTCGAGGGCCTGACCCAGATCTTCCAGAAGGCCTACGAGCACGAGCAGCACATCTCCGAGTCC
ATCAACAACATCGTGGACCACGCCATCAAGTCCAAGGACCACGCCACCTTCAACTTCCTGCAGTGG
TACGTGGCCGAGCAGCACGAGGAGGAGGTGCTGTTCAAGGACATCCTGGACAAGATCGAGCTGATC
GGCAACGAGAACCACGGCCTGTACCTGGCCGACCAGTACGTGAAGGGCATCGCCAAGTCCCGCAAG
TCCTGATAA

Figure 24G cont.

**>CH505M5chimv4.1-ferritin (signal peptide; ferritin, *glycine* linker) (SEQ ID NO. 312)**

MPMGSLQPLATLYLLGMLVASVLAAENLWVTVYYGVPVWKEAKTTLFCASDAKAYEKKVH
NVWATHACVPTDPNPQEMVLKNVTENFNMWKNDMVDQMHEDVISLWDQSLKPCVKLTPLC
VTLNCTNATASNSSIIEGMKNCSFNITTELRDKREKKNALFYKLDIVQLDGNSSQYRLIN
CNTSVITQACPKVSFDPIPIHYCAPAGYAILKCNNKTFTGTGPCNNVSTVQCTHGIKPVV
STQLLLNGSLAEGEIIIRSENITKNVKTIIVHLNESVKIECTRPNNKTRTSIRIGPGQWF
YATGQVIGDIREAYCNINESKWNETLQRVSKKLKEYFPHKNITFQPSSGGDLEITTHSFN
CGGEFFYCNTSSLFNRTYMANSTDMANSTETNSTRTITIHCRIKQIINMWQEVGRAMYAP
PIAGNITCISNITGLLLTRDGGKNNTETFRPGGGNMKDNWRSELYKYKVVKIEPLGVAPT
RCKRRVVGRRRRRRAVGIGAVFLGFLGAAGSTMGAASMTLTVQARNLLSGIVQQQSNLLR
APEAQQHLLKLTVWGIKQLQARVLAVERYLRDQQLLGIWGCSGKLICCTNVPWNSSWSNR
NLSEIWDNMTWLQWDKEISNYTQIIYGLLEESQNQQEKNEQDLLALD*GGG*SGDIIKLLNE
QVNKEMNSSNLYMSMSSWCYTHSLDGAGLFLFDHAAEEYEHAKKLIIFLNENNVPVQLTS
ISAPEHKFEGLTQIFQKAYEHEQHISESINNIVDHAIKSKDHATFNFLQWYVAEQHEEEV
LFKDILDKIELIGNENHGLYLADQYVKGIAKSRKS**

Figure 24G cont.

>CH505M5chimv4.1-ferritin(HV1301349) (SEQ ID NO. 313)

ATGCCCATGGGCTCCCTGCAGCCCCTGGCCACCCTGTACCTGCTGGGCATGCTGGTGGCCTCCGTG
CTGGCCGCCGAGAACCTGTGGGTGACCGTGTACTACGGCGTGCCCGTGTGGAAGGAGGCCAAGACC
ACCCTGTTCTGCGCCTCCGACGCCAAGGCCTACGAGAAGAAGGTGCACAACGTGTGGGCCACCCAC
GCCTGCGTGCCCACCGACCCCAACCCCCAGGAGATGGTGCTGAAGAACGTGACCGAGAACTTCAAC
ATGTGGAAGAACGACATGGTGGACCAGATGCACGAGGACGTGATCTCCCTGTGGGACCAGTCCCTG
AAGCCCTGCGTGAAGCTGACCCCCCTGTGCGTGACCCTGAACTGCACCAACGCCACCGCCTCCAAC
TCCTCCATCATCGAGGGCATGAAGAACTGCTCCTTCAACATCACCACCGAGCTGCGCGACAAGCGC
GAGAAGAAGAACGCCCTGTTCTACAAGCTGGACATCGTGCAGCTGGACGGCAACTCCTCCCAGTAC
CGCCTGATCAACTGCAACACCTCCGTGATCACCCAGGCCTGCCCCAAGGTGTCCTTCGACCCCATC
CCCATCCACTACTGCGCCCCCGCCGGCTACGCCATCCTGAAGTGCAACAACAAGACCTTCACCGGC
ACCGGCCCCTGCAACAACGTGTCCACCGTGCAGTGCACCCACGGCATCAAGCCCGTGGTGTCCACC
CAGCTGCTGCTGAACGGCTCCCTGGCCGAGGGCGAGATCATCATCCGCTCCGAGAACATCACCAAG
AACGTGAAGACCATCATCGTGCACCTGAACGAGTCCGTGAAGATCGAGTGCACCCGCCCCAACAAC
AAGACCCGCACCTCCATCCGCATCGGCCCCGGCCAGTGGTTCTACGCCACCGGCCAGGTGATCGGC
GACATCCGCGAGGCCTACTGCAACATCAACGAGTCCAAGTGGAACGAGACCCTGCAGCGCGTGTCC
AAGAAGCTGAAGGAGTACTTCCCCCACAAGAACATCACCTTCCAGCCCTCCTCCGGCGGCGACCTG
GAGATCACCACCCACTCCTTCAACTGCGGCGGCGAGTTCTTCTACTGCAACACCTCCTCCCTGTTC
AACCGCACCTACATGGCCAACTCCACCGACATGGCCAACTCCACCGAGACCAACTCCACCCGCACC
ATCACCATCCACTGCCGCATCAAGCAGATCATCAACATGTGGCAGGAGGTGGGCCGCGCCATGTAC
GCCCCCCCCATCGCCGGCAACATCACCTGCATCTCCAACATCACCGGCCTGCTGCTGACCCGCGAC
GGCGGCAAGAACAACACCGAGACCTTCCGCCCCGGCGGCGGCAACATGAAGGACAACTGGCGCTCC
GAGCTGTACAAGTACAAGGTGGTGAAGATCGAGCCCCTGGGCGTGGCCCCCACCCGCTGCAAGCGC
CGCGTGGTGGGCCGCCGCCGCCGCCGCCGCGCCGTGGGCATCGGCGCCGTGTTCCTGGGCTTCCTG
GGCGCCGCCGGCTCCACCATGGGCGCCGCCTCCATGACCCTGACCGTGCAGGCCCGCAACCTGCTG
TCCGGCATCGTGCAGCAGCAGTCCAACCTGCTGCGCGCCCCCGAGGCCCAGCAGCACCTGCTGAAG
CTGACCGTGTGGGGCATCAAGCAGCTGCAGGCCCGCGTGCTGGCCGTGGAGCGCTACCTGCGCGAC
CAGCAGCTGCTGGGCATCTGGGGCTGCTCCGGCAAGCTGATCTGCTGCACCAACGTGCCCTGGAAC
TCCTCCTGGTCCAACCGCAACCTGTCCGAGATCTGGGACAACATGACCTGGCTGCAGTGGGACAAG
GAGATCTCCAACTACACCCAGATCATCTACGGCCTGCTGGAGGAGTCCCAGAACCAGCAGGAGAAG
AACGAGCAGGACCTGCTGGCCCTGGACGGCGGCGGCTCCGGCGACATCATCAAGCTGCTGAACGAG
CAGGTGAACAAGGAGATGAACTCCTCCAACCTGTACATGTCCATGTCCTCCTGGTGCTACACCCAC
TCCCTGGACGGCGCCGGCCTGTTCCTGTTCGACCACGCCGCCGAGGAGTACGAGCACGCCAAGAAG
CTGATCATCTTCCTGAACGAGAACAACGTGCCCGTGCAGCTGACCTCCATCTCCGCCCCCGAGCAC
AAGTTCGAGGGCCTGACCCAGATCTTCCAGAAGGCCTACGAGCACGAGCAGCACATCTCCGAGTCC
ATCAACAACATCGTGGACCACGCCATCAAGTCCAAGGACCACGCCACCTTCAACTTCCTGCAGTGG
TACGTGGCCGAGCAGCACGAGGAGGAGGTGCTGTTCAAGGACATCCTGGACAAGATCGAGCTGATC
GGCAACGAGAACCACGGCCTGTACCTGGCCGACCAGTACGTGAAGGGCATCGCCAAGTCCCGCAAG
TCCTAGTAA

Figure 24G cont.

Identical binding patterns were observed for weeks 53, 78, and 100 gp140

| Autologous Tier 1 (CH505w4.3) plasma neutralization titer (ID50; reciprocal dilution) | | | | |
|---|---|---|---|---|
| Study week | Group 2 CH505 gp140C | | | |
| | NHP 6207 | NHP 6429 | NHP 6430 | NHP 6436 |
| 0 | <20 | <20 | <20 | <20 |
| 6 | <20 | 409 | <20 | *63 |
| 11 | 192 | 8242 | 205 | 1298 |
| 18 | 342 | 1174 | 117 | 1122 |
| 24 | 657 | 1023 | 524 | 2325 |
| 30 | 1851 | 1161 | 1090 | 3035 |
| 36 | 2216 | 2337 | 887 | 4575 |

*SVA-MLV was also positive

Titer Scale (ID50)

| <20 | 20-90 | 91-499 | 500-1000 | >1000 |
|---|---|---|---|---|

| Autologous Tier 2 (CH505 TF) plasma neutralization titer (ID50; reciprocal dilution) | | | | |
|---|---|---|---|---|
| Study week | Group 2 CH505 gp140 | | | |
| | NHP 6207 | NHP 6429 | NHP 6430 | NHP 6436 |
| 0 | <20 | <20 | <20 | <20 |
| 6 | <20 | <20 | <20 | *45 |
| 11 | <20 | <20 | <20 | <20 |
| 18 | 32 | <20 | <20 | <20 |
| 24 | 52 | <20 | <20 | <20 |
| 30 | 114 | <20 | <20 | <20 |
| 36 | 167 | <20 | <20 | <20 |

*SVA-MLV was also positive

Titer Scale (ID50)

| <20 | 20-90 | 91-499 | 500-1000 | >1000 |
|---|---|---|---|---|

| Plasma autologous neutralization titer (ID50; reciprocal dilution) | | | | | | |
|---|---|---|---|---|---|---|
| NPH ID | Study week | SVA-MLV | CH0505 TF | CH0505 w53.16 | CH0505 w78.33 | CH0505 w100.B6 |
| | | NA | Tier 2 | Tier 2 | Tier 2 | Tier 2 |
| 6207 | 0 | <20 | <20 | <20 | <20 | <20 |
| | 6 | <20 | <20 | <20 | <20 | <20 |
| | 11 | <20 | <20 | <20 | <20 | <20 |
| | 18 | <20 | 32 | <20 | 27 | 28 |
| | 24 | <20 | 52 | 24 | 47 | 37 |
| | 30 | <20 | 114 | 45 | 76 | 76 |
| | 36 | <20 | 167 | 91 | 134 | 89 |

Titer Scale

| | | | | |
|---|---|---|---|---|
| <20 | 20-90 | 91-499 | 500-1000 | >1000 |

| 6207 Plasma neutralization titer (ID50; reciprocal dilution) | | | |
|---|---|---|---|
| Virus | Tier | Study week | |
| | | 30 | 36 |
| SVA-MLV | NA | <20 | <20 |
| 398-F1-F6_20 | Tier 2 | <20 | 21 |
| 25710-2.43 | Tier 2 | <20 | 23 |
| CNE8 | Tier 2 | <20* | 30 |
| TRO.11 | Tier 2 | 108 | 97 |
| X2278_C2_B6 | Tier 2 | <20 | 29 |
| BJOX002000.03.2 | Tier 2 | <20 | 21 |
| X1632_S2_B10 | Tier 2 | <20* | <20* |
| Ce1176_A3 | Tier 2 | <20* | 27 |
| 246-F3_C10_2 | Tier 2 | <20 | <20* |
| CH119.10 | Tier 2 | <20* | 21 |
| Ce703010217_B6 | Tier 2 | <20 | <20 |
| CNE55 | Tier 2 | 84 | 91 |

*Percent neutralization >40%

9/12 (75%) heterologous tier 2 viruses were neutralized

Titer Scale

| | | | | |
|---|---|---|---|---|
| <20 | 20-90 | 91-499 | 500-1000 | >1000 |

Figure 32

| Week # | Group # | Animal # | Sorted phenotype |
|---|---|---|---|
| 30 | 2 | 6207 | RSC3$^+$ and ΔRSC3$^-$ |
| 30 | 2 | 6436 | RSC3$^+$ and ΔRSC3$^-$ |

| | 97 | 275 | 278 | 279 | 281 | 471 | V5length |
|---|---|---|---|---|---|---|---|
| M5 | K | E | T | K | V | G | 8 |
| 30.25 | K | E | T | N | A | G | 10 |
| 53.25 | E | E | T | D | G | G | 11 |
| 53.29 | K | E | T | N | A | E | 11 |

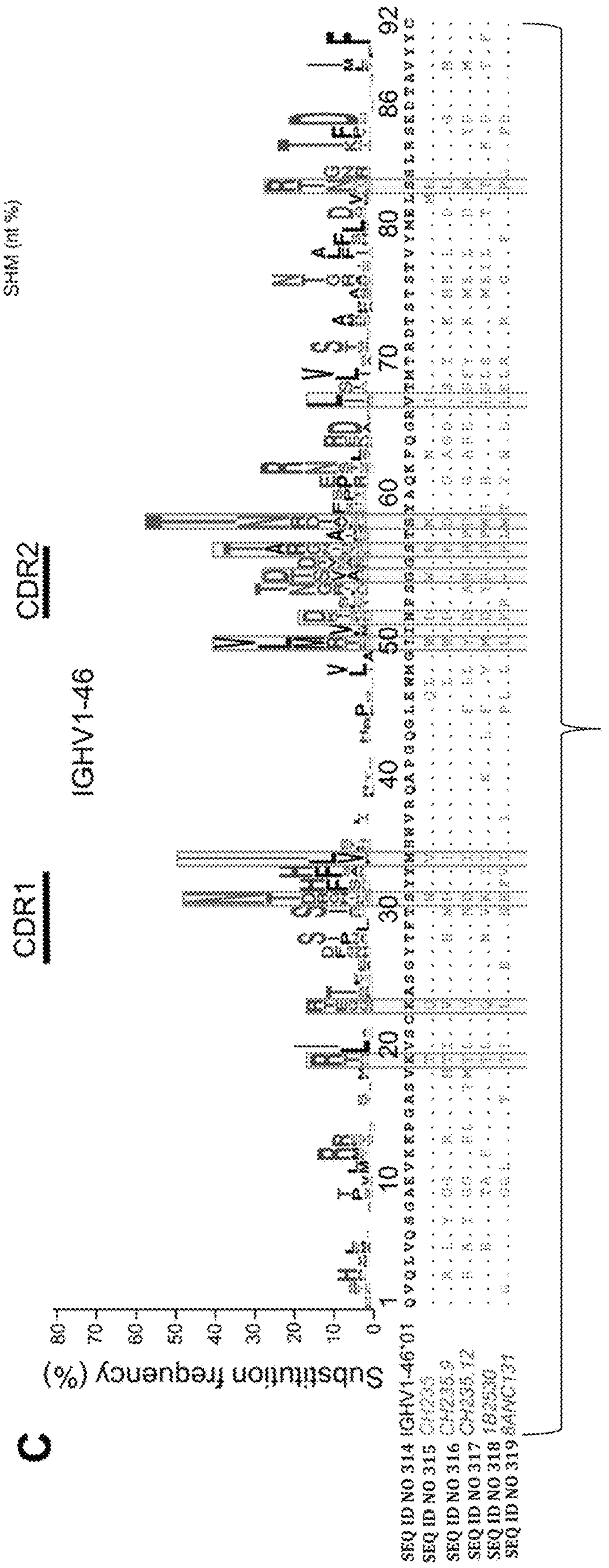
continued on next sheet
Figure 43C continued from above

SEQ ID NO 320
SEQ ID NO 321
SEQ ID NO 322
SEQ ID NO 323

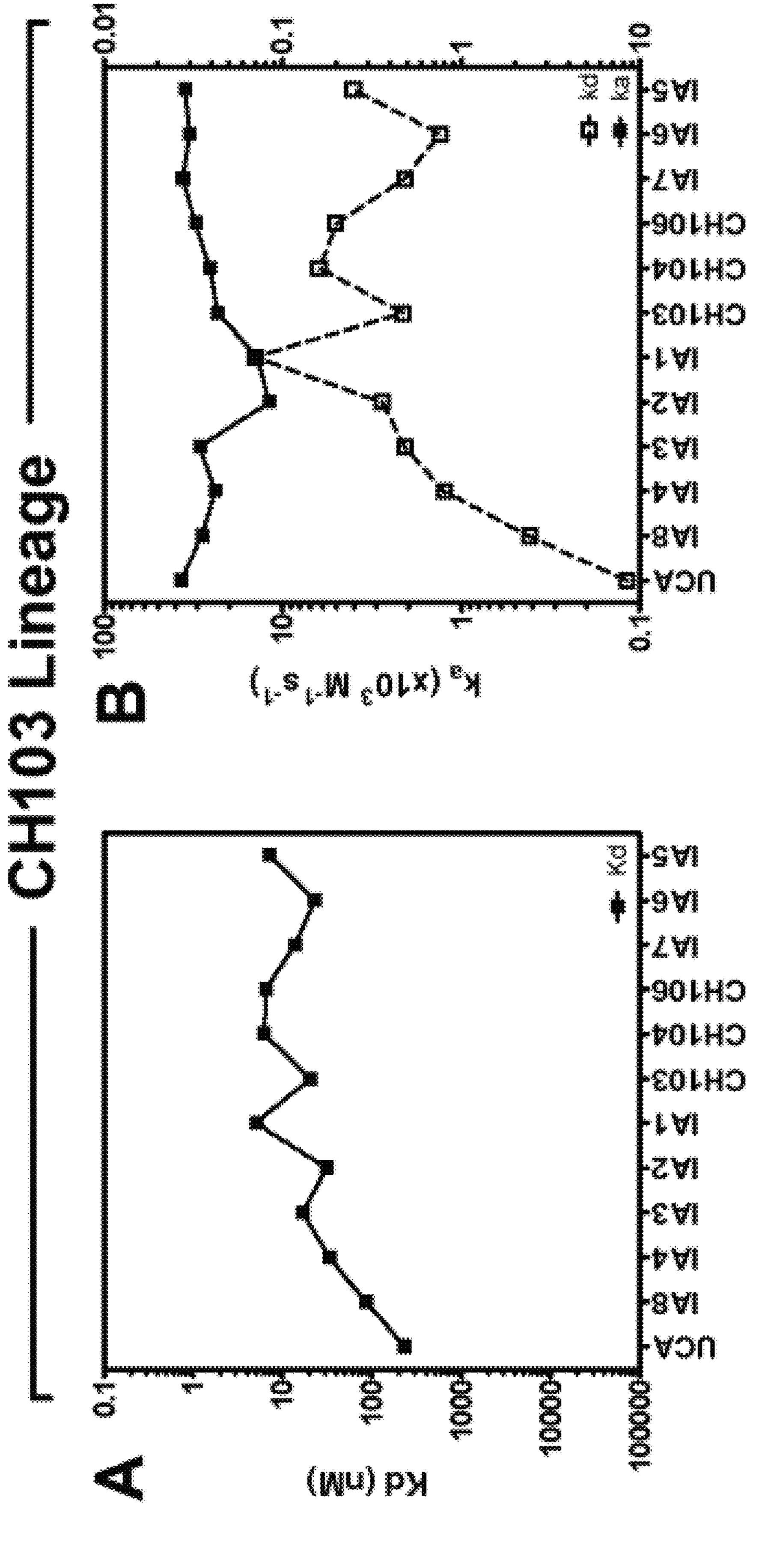
Figures 44A-B

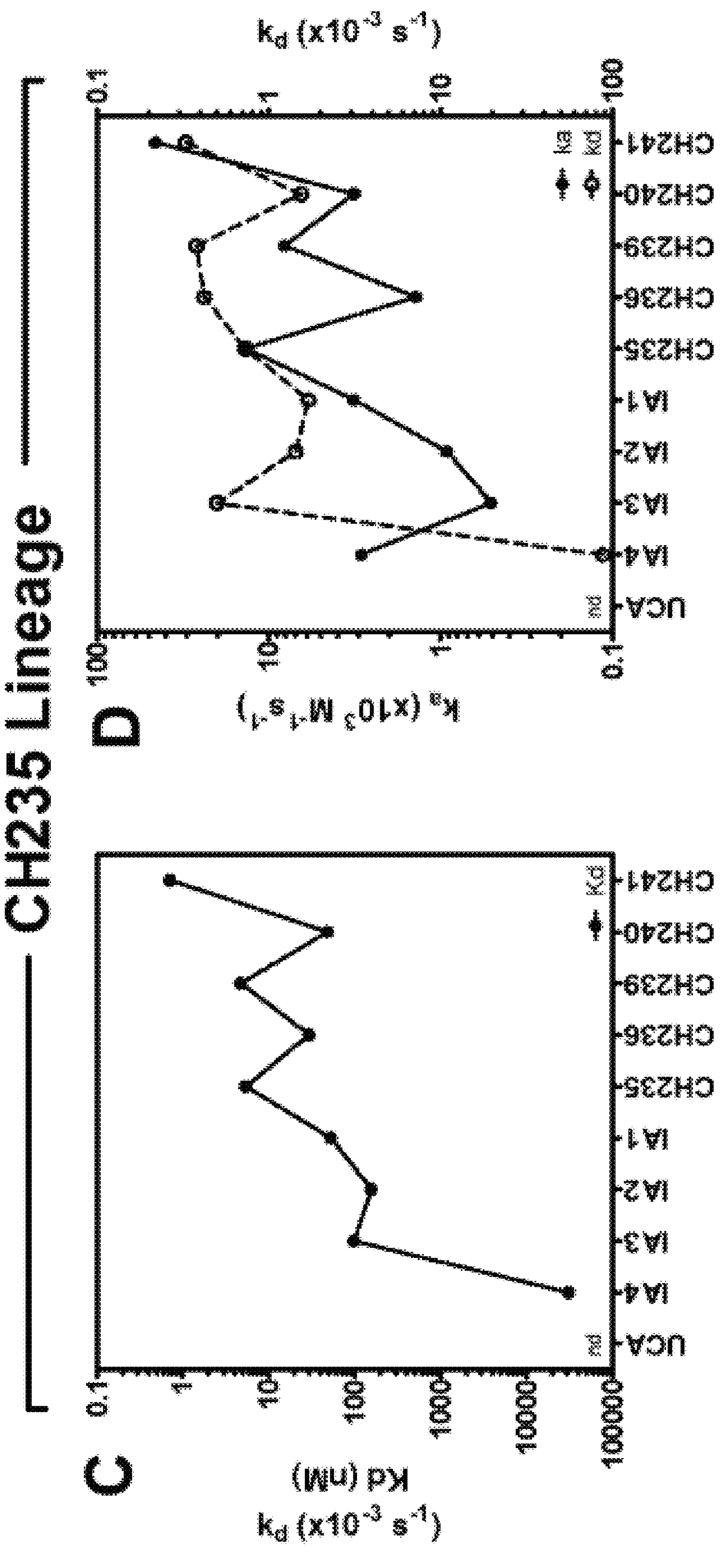
Figures 44C-D

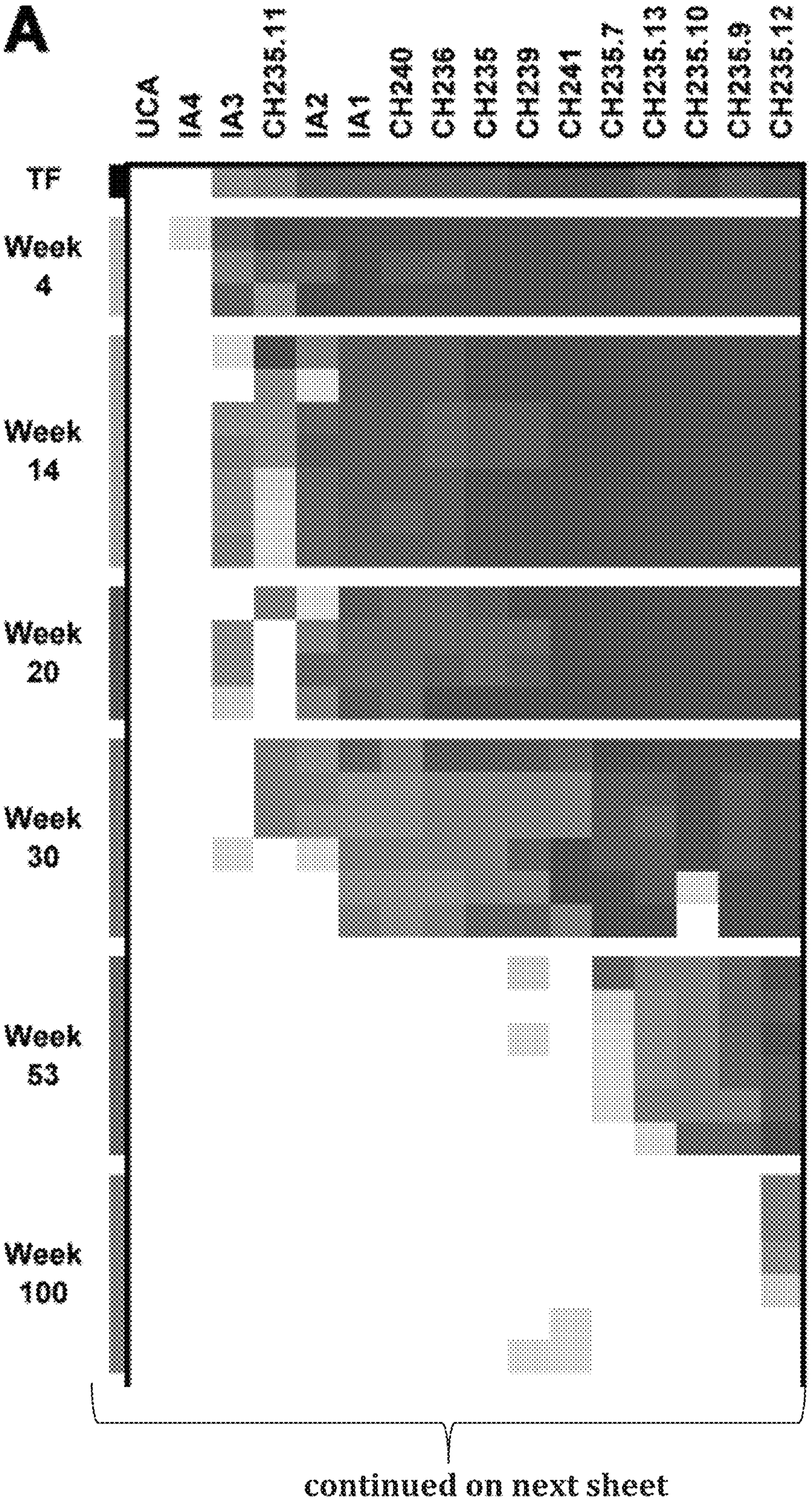
continued on next sheet
Figure 45A continued from above

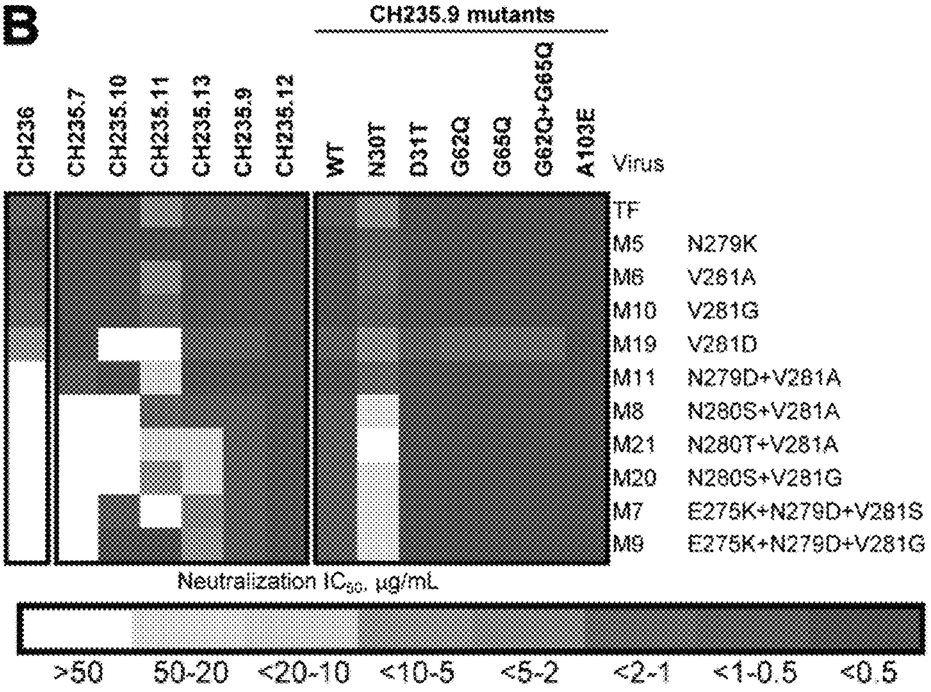
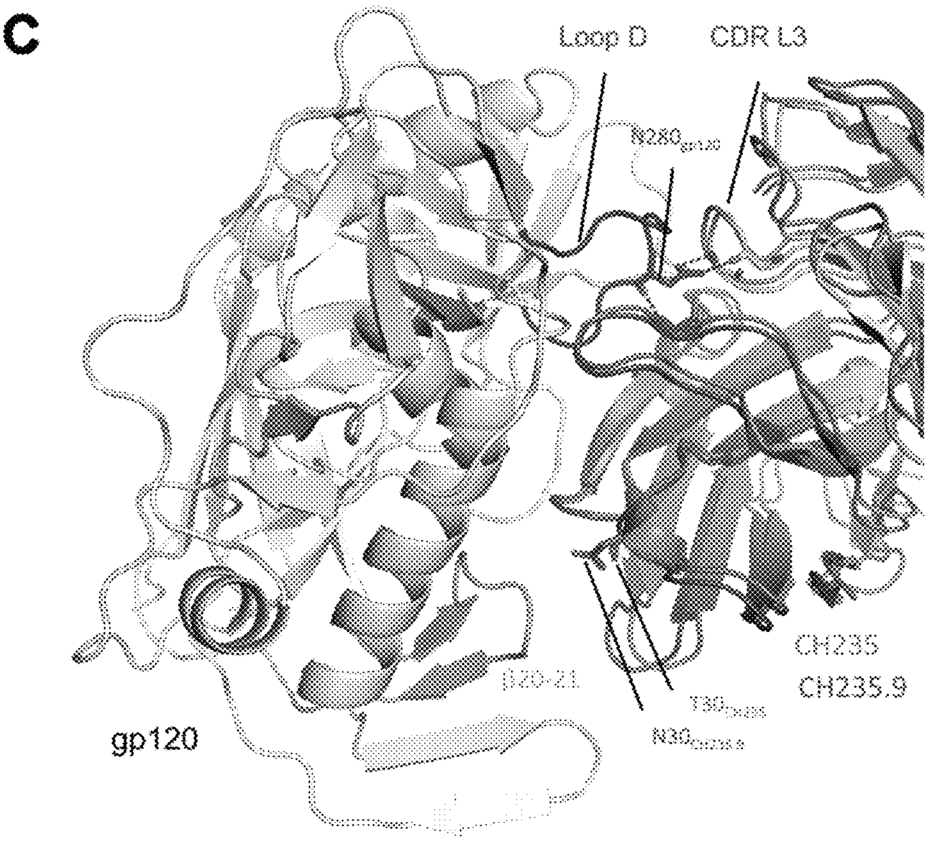
Figures 45B-C

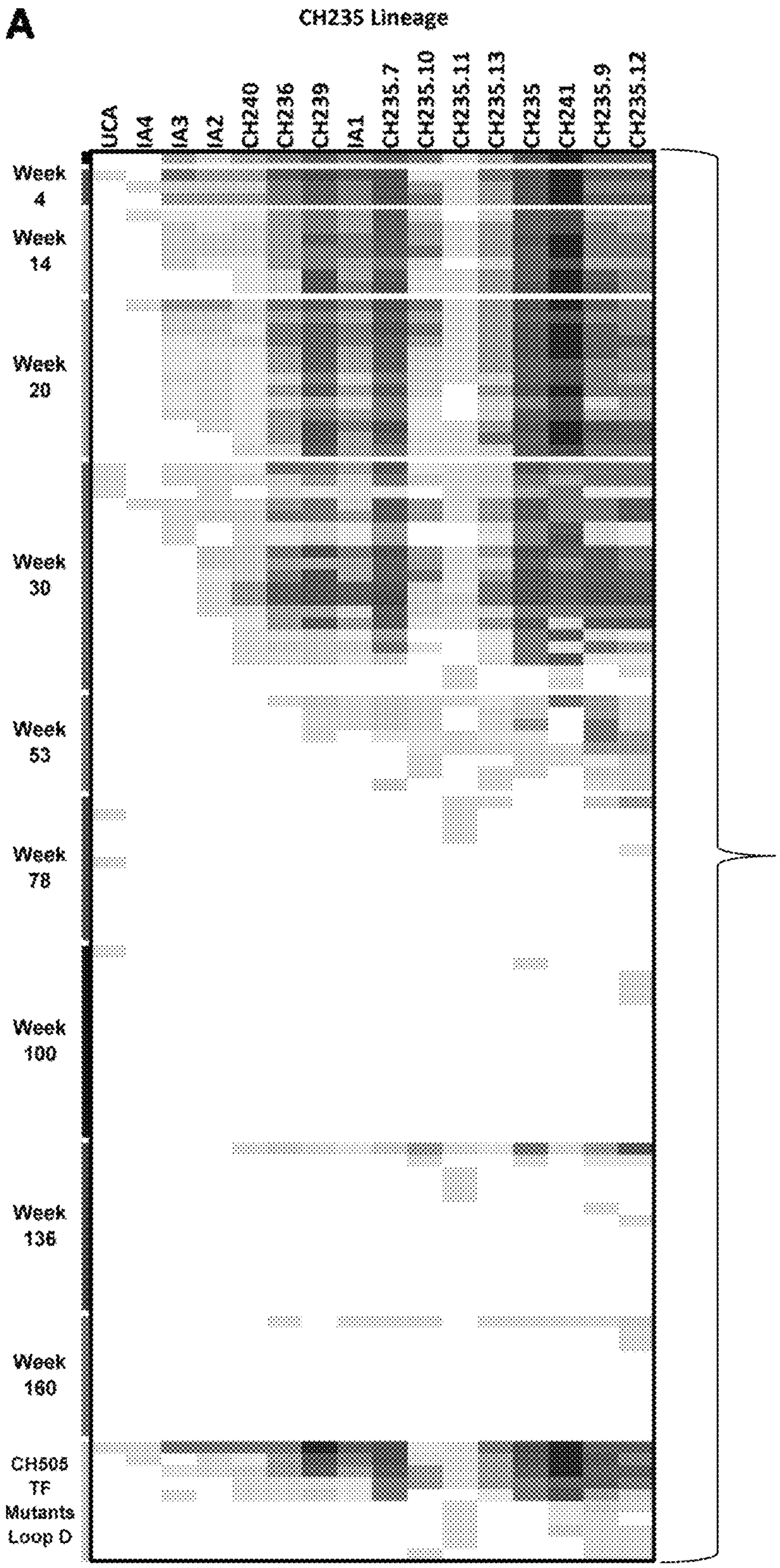
continued on next sheet
Figure 46A

A

| | SSA | SSB | Sm | RNP | Scl70 | Jo1 | DNA | Cent. B | Histone |
|---|---|---|---|---|---|---|---|---|---|
| UCA | - | - | - | - | - | - | - | - | - |
| IA4 | - | - | - | - | - | - | - | - | - |
| IA1 | - | - | - | - | - | - | - | - | - |
| CH240 | - | - | - | - | - | - | - | - | - |
| CH239 | - | - | - | - | - | - | - | - | - |
| IA3 | - | - | - | - | - | - | + | - | - |
| IA2 | - | - | - | - | - | - | + | - | - |
| CH236 | - | - | - | - | - | - | + | - | - |
| CH235 | - | - | - | - | - | - | - | - | - |
| CH241 | - | - | - | - | - | - | + | - | - |
| CH235.7 | - | - | - | - | + | - | +++ | - | - |
| CH235.9 | - | - | - | - | - | - | + | - | - |
| CH235.10 | - | - | - | - | - | - | + | - | - |
| CH235.13 | - | - | - | - | - | - | - | - | - |
| CH235.11 | - | - | - | - | - | - | - | - | - |
| CH235.12 | - | - | - | - | - | - | - | - | - |

Figure 47A

```
SEQ ID NO. 386 VH1-46*01   QVQLVQSGAEVKKPGASVKVSCKASGYTFTSYYMHWVRQAPGQGLEWMG
SEQ ID NO. 387 8ANC131     .G......GGL....T..TI..L..E...NEFVI..I.......PL.L.
SEQ ID NO. 388 CH235       ..................T...Q......N..V...........QL...

               VH1-46*01   IINPSGGSTSYAQKFQGRVTMTRDTSTSTVYMELSSLRSEDTAVYYCAR
               8ANC131     L.KR.-.RLMT.YN..D.LSLR..R..G..F...RG..PD.........
               CH235       W.D..W.R.N...N....I..............MS..............
```

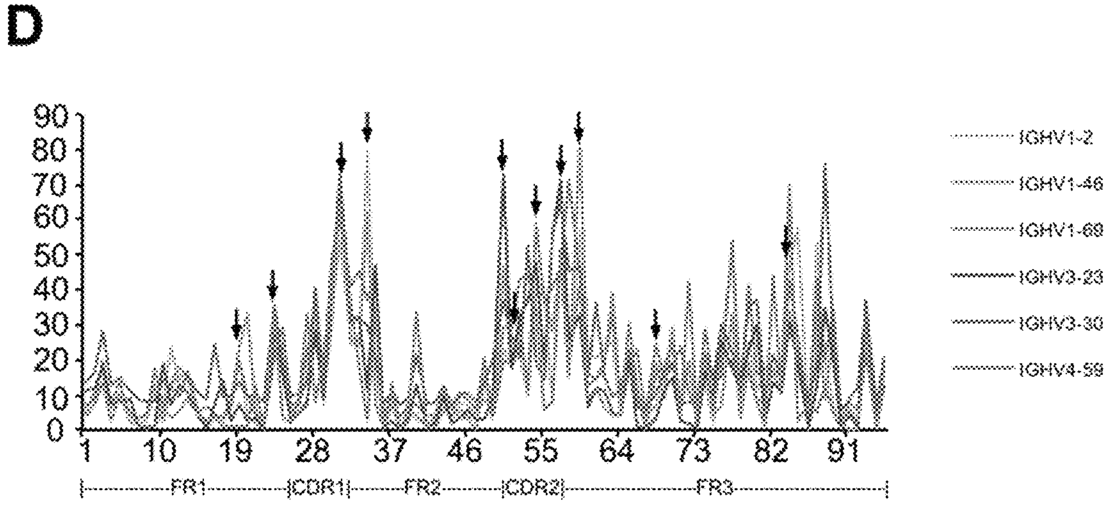
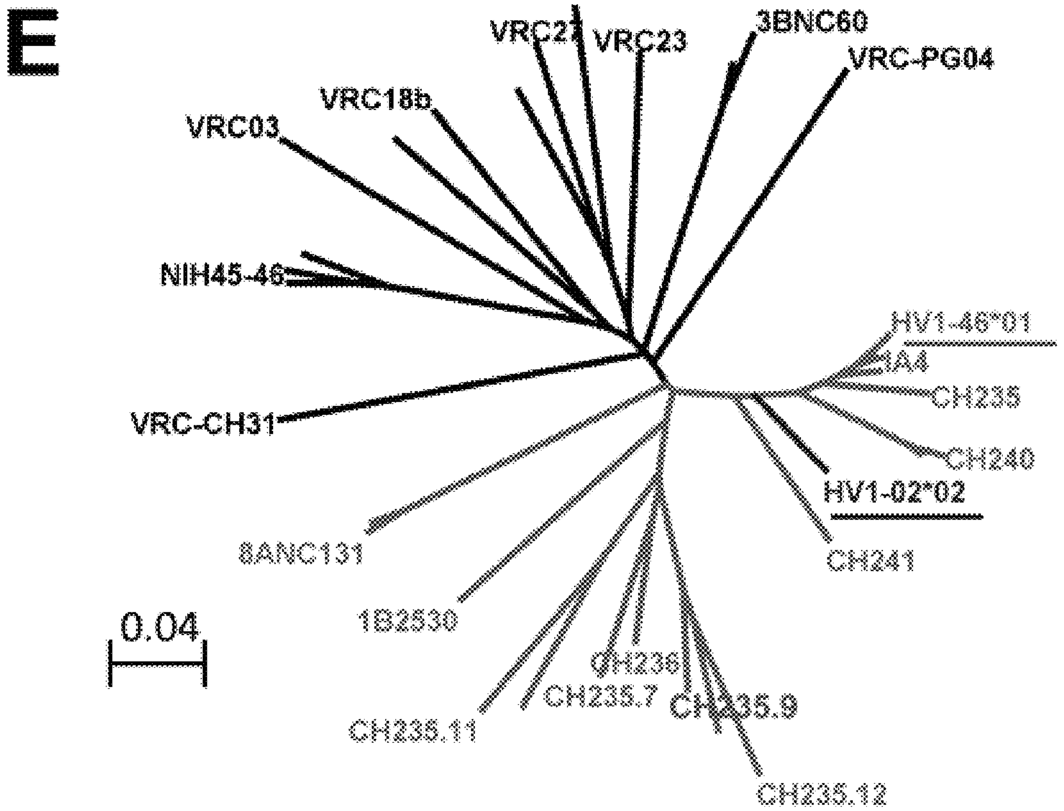
Figures 50D-E

```
          |--------FR1--------|   |---CDR1---|   |-------FR2-------|   |--CDR2--|
                                                                          *****
                                         *                                *****
CH236_VH    QVQLVQSGAA VKRPGASVTI SCRASGYTFT TYYIHWVRQA PGQRLELMGM IDPSRGRTDY
CH235.9_VH  QVRLLQYGGG VKRPGASMTI SCVASGYNFN DYYIHWVRQA PGQGLELMGW IDPSGGRTDY
CH235.12_VH QVRLAQYGGG VKRLGATMTL SCVASGYTFN DYYIHWVRQA PGQGFELLGY IDPANGRPDY
CH235.13_VH QVQLVQSGGG VKRPGSTTTI SCVASGYSFN DYYIHWVRQA PGQGLEVLGF IDPSNGRTNY
CH235.10_VH QVQLVQSGAT VKKPRASVTL SCRTSGYNFI DYFIHWVRRA PGQRLEVMGY IDPSRGRPDY
CH235.11_VH QVQLVQSGGT VKSPGTSVTL SCKTSGYNFI DYYIHWVRRA PGQRPELMGY IDPSHGRPDY
CH235.7_VH  QVQLVQSGAA VKRPGASVTI SCRASGYTFT TYYIHWVRQA PGQGLELMGW INPRGGRTDY

          |--------FR3--------|                       |---CDR3---|   |----FR4----|
                *                                     ******
              **                                      ******
CH236_VH    AQKFQGRVTM SRDTSTSTLY MELRSLRPDD TALYYCVRNV GTEGSLLHYD YWGQGTLVTVSS
CH235.9_VH  AGAFGDRVSM YRDKSMNTLY MDLRSLRSGD TAMYYCVRNV GTAGSLLHYD HWGLGVMVTVSS
CH235.12_VH AGALRERLSF YRDKSMETLY MDLRSLRYDD TAMYYCVRNV GTAGSLLHYD HWGSGSPVIVSS
CH235.13_VH AGAFGDRFSM YRDKSMETLY MDLRNLRSDD TAMYYCVRNV GTAGSLLHYD HWGTGSKIIVSS
CH235.10_VH APNFRDRVSL YRDTSMSIVY LDLRDLTPDD TAIYYCVRSE GTEGTVLHYD HWGPGTRVTVSP
CH235.11_VH EGKFRDRISL YRDTSTSVVY MDVRGLRLDD TALYYCVRGG GVEVSSNHYD HWGPGTMVFVSP
CH235.7_VH  SYRFEDRVSM YRDTSMSIVY MDLRNLKSAD TAVYYCVRNV GTSGSLLHYD FWGQGSLVTVSS

                                    Figure 51B
```

| Antibody ID | VH | D | JH | Mutation frequency | CDRH3 length |
|---|---|---|---|---|---|
| UCA | 1-46*01 | 3-10*01 | 4*02 | 0.0% | 15 |
| CH235 | 1-46*01 | 3-10*01 | 4*02 | 7.9% | 15 |
| CH236 | 1-46*01 | 3-10*01 | 4*02 | 8.2% | 15 |
| CH239 | 1-46*01 | 3-10*01 | 4*02 | 7.9% | 15 |
| CH240 | 1-46*01 | 3-10*01 | 4*02 | 7.4% | 15 |
| CH241 | 1-46*01 | 3-10*01 | 4*02 | 11.5% | 15 |
| CH235.6 | 1-46*01 | 3-10*01 | 4*02 | 12.6% | 15 |
| CH235.7 | 1-46*01 | 3-10*01 | 4*02 | 14.8% | 15 |
| CH235.8 | 1-46*01 | 3-10*01 | 4*02 | 12.0% | 15 |
| CH235.9 | 1-46*01 | 3-10*01 | 4*02 | 19.6% | 15 |
| CH235.10 | 1-46*01 | 3-10*01 | 4*02 | 21.6% | 15 |
| CH235.11 | 1-46*01 | 3-10*01 | 4*02 | 25.1% | 15 |
| CH235.12 | 1-46*01 | 3-10*01 | 4*02 | 25.7% | 15 |
| CH235.13 | 1-46*01 | 3-10*01 | 4*02 | 23.5% | 15 |

Figure 53

| Antibody ID | VK | JK | Mutation frequency | CDRL3 length | Week of isolation |
|---|---|---|---|---|---|
| **UCA** | 3-15*01 | 1*01 | 0.0% | 8 | - |
| **CH235** | 3-15*01 | 1*01 | 3.8% | 8 | 41 |
| **CH236** | 3-15*01 | 1*01 | 2.8% | 8 | 41 |
| **CH239** | 3-15*01 | 1*01 | 4.7% | 8 | 41 |
| **CH240** | 3-15*01 | 1*01 | 3.1% | 8 | 41 |
| **CH241** | 3-15*01 | 1*01 | 3.5% | 8 | 41 |
| **CH235.6** | 3-15*01 | 1*01 | 3.5% | 8 | 66^ |
| **CH235.7** | 3-15*01 | 1*01 | 2.8% | 8 | 100# |
| **CH235.8** | 3-15*01 | 1*01 | 3.5% | 8 | 100^ |
| **CH235.9** | 3-15*01 | 1*01 | 2.8% | 8 | 152# |
| **CH235.10** | 3-15*01 | 1*01 | 16.7% | 8 | 264 |
| **CH235.11** | 3-15*01 | 1*01 | 17.6% | 8 | 323 |
| **CH235.12** | 3-15*01 | 1*01 | 12.9% | 8 | 323 |
| **CH235.13** | 3-15*01 | 1*01 | 11.6% | 8 | 323 |

^ Paired with CH241 V-light chain and complemented with CH241 V-heavy.

Paired with CH236 V-light chain and complemented with CH236 V-heavy.

Mutation frequency is calculated on nucleotide sequences of the whole V(D)J rearrangement compared to UCA.

CDR H3 and CDR L3 lengths are expressed in amino acids.

Figure 53 cont.

| Virus ID | Clade | CH235 | CH235.9 | CH235.12 | VRC01 |
|---|---|---|---|---|---|
| 0260.v5.c36 | A | >50 | 10.5 | 1.02 | 0.468 |
| 0330.v4.c3 | A | >50 | 1.88 | 0.313 | 0.047 |
| 0439.v5.c1 | A | >50 | 3.49 | 0.374 | 0.129 |
| 3365.v2.c20 | A | >50 | 1.29 | 0.068 | 0.030 |
| 3415.v1.c1 | A | >50 | 3.20 | 0.450 | 0.084 |
| 3718.v3.c11 | A | 12.3 | 1.80 | 0.360 | 0.165 |
| 398-F1_F6_20 | A | >50 | 5.48 | 1.76 | 0.181 |
| BB201.B42 | A | >50 | 7.20 | 0.573 | 0.316 |
| BG505.W6M.C2 | A | >50 | 0.823 | 0.111 | 0.053 |
| BI369.9A | A | >50 | 1.95 | 0.290 | 0.224 |
| BS208.B1 | A | >50 | 1.77 | 0.263 | 0.022 |
| KER2008.12 | A | >50 | >50 | >50 | 0.591 |
| KER2018.11 | A | >50 | 9.89 | 2.52 | 0.555 |
| KNH1209.18 | A | >50 | 1.21 | 0.251 | 0.099 |
| MB201.A1 | A | >50 | 12.9 | 0.333 | 0.212 |
| MB539.2B7 | A | >50 | 11.7 | 1.71 | 0.500 |
| MI369.A5 | A | >50 | 2.64 | 0.416 | 0.269 |
| MS208.A1 | A | >50 | 2.77 | 0.463 | 0.178 |
| Q23.17 | A | 1.35 | 0.405 | 0.132 | 0.052 |
| Q259.17 | A | >50 | 7.46 | 0.100 | 0.075 |
| Q769.d22 | A | >50 | 0.981 | 0.110 | 0.035 |
| Q769.h5 | A | >50 | 2.55 | 0.139 | 0.062 |
| Q842.d12 | A | 8.15 | 0.378 | 0.091 | 0.038 |
| QH209.14M.A2 | A | >50 | 5.76 | 0.374 | 0.060 |
| RW020.2 | A | 1.20 | 1.05 | 0.301 | 0.203 |
| UG037.8 | A | >50 | 1.10 | 0.188 | 0.089 |
| 246-F3.C10.2 | AC | | 1.33 | | |
| 3301.V1.C24 | AC | 20.9 | 1.91 | 0.473 | 0.097 |
| 3589.V1.C4 | AC | >50 | >50 | 0.309 | 0.047 |
| 6540.v4.c1 | AC | >50 | >50 | >50 | >50 |
| 6545.V4.C1 | AC | >50 | >50 | >50 | >50 |

Figure 54

| | | | | | |
|---|---|---|---|---|---|
| 0815.V3.C3 | ACD | >50 | 0.549 | 0.056 | 0.015 |
| 6095.V1.C10 | ACD | >50 | 3.29 | 1.33 | 0.506 |
| 3468.V1.C12 | AD | 2.47 | 0.659 | 0.070 | 0.050 |
| Q168.a2 | AD | >50 | 1.10 | 0.261 | 0.098 |
| Q461.e2 | AD | >50 | 6.95 | 0.818 | 0.497 |
| 620345.c1 | AE | >50 | 8.61 | 1.94 | >50 |
| BJOX009000.02.4 | AE | >50 | >50 | 5.50 | 1.54 |
| BJOX010000.06.2 | AE | >50 | >50 | 10.6 | 6.79 |
| BJOX025000.01.1 | AE | 40.6 | 0.586 | 0.271 | 8.46 |
| BJOX028000.10.3 | AE | >50 | 0.886 | 0.168 | 0.256 |
| C1080.c3 | AE | >50 | 13.3 | 2.69 | 2.10 |
| C2101.c1 | AE | 12.6 | 3.37 | 0.261 | 0.179 |
| C3347.c11 | AE | >50 | 0.482 | 0.117 | 0.095 |
| C4118.09 | AE | 3.30 | 1.04 | 0.084 | 0.248 |
| CM244.ec1 | AE | 1.19 | | 0.160 | 0.089 |
| CNE3 | AE | >50 | >50 | 2.45 | 1.63 |
| CNE5 | AE | 17.6 | 2.94 | 1.03 | 0.323 |
| CNE55 | AE | >50 | 1.90 | 0.400 | 0.359 |
| CNE56 | AE | 42.9 | 2.96 | 1.10 | 0.343 |
| CNE59 | AE | 13.6 | 3.79 | 0.943 | 0.623 |
| CNE8 | AE | >50 | 3.22 | 1.10 | 0.510 |
| R1166.c1 | AE | >50 | 34.4 | 0.758 | 3.00 |
| R2184.c4 | AE | 5.82 | 6.83 | 0.563 | 0.133 |
| R3265.c6 | AE | >50 | 35.0 | 0.172 | 0.710 |
| TH966.8 | AE | 0.732 | 1.70 | 0.304 | 0.284 |
| TH976.17 | AE | 0.975 | 0.935 | 0.286 | 0.332 |
| 235-47 | AG | >50 | 2.25 | 0.293 | 0.061 |
| 242-14 | AG | >50 | >50 | 2.83 | >50 |
| 263-8 | AG | >50 | 2.93 | 0.447 | 0.168 |

Figure 54 cont.

| Virus ID | Clade | CH235 | CH235.9 | CH235.12 | VRC01 |
|---|---|---|---|---|---|
| 269-12 | AG | >50 | >50 | >50 | 0.293 |
| 271-11 | AG | >50 | 0.652 | 0.090 | 0.054 |
| 928-28 | AG | >50 | 3.55 | 0.542 | 0.476 |
| DJ263.8 | AG | >50 | 2.90 | 0.276 | 0.066 |
| T250-4 | AG | >50 | >50 | >50 | >50 |
| T251-18 | AG | >50 | >50 | 4.02 | 4.42 |
| T253-11 | AG | >50 | >50 | 1.65 | 0.501 |
| T255-34 | AG | >50 | 7.83 | 0.608 | 0.725 |
| T257-31 | AG | >50 | 13.3 | 2.66 | 2.47 |
| T266-60 | AG | >50 | >50 | 10.3 | 2.37 |
| T278-50 | AG | >50 | >50 | >50 | >50 |
| T280-5 | AG | >50 | 0.308 | 0.109 | 0.059 |
| T33-7 | AG | >50 | 0.469 | 0.039 | 0.019 |
| 3988.25 | B | >50 | 3.49 | 0.917 | 0.369 |
| 5768.04 | B | >50 | 3.75 | 0.715 | 0.354 |
| 6101.10 | B | >50 | 3.14 | 0.467 | 0.023 |
| 6535.3 | B | >50 | >50 | 4.85 | 2.10 |
| 7165.18 | B | >50 | >50 | >50 | 45.0 |
| 45_01dG5 | B | >50 | 0.507 | 0.058 | 0.011 |
| 89.6.DG | B | >50 | 27.7 | 2.23 | 1.30 |
| AC10.29 | B | >50 | 9.55 | 2.13 | 1.41 |
| ADA.DG | B | >50 | 2.88 | 0.907 | 0.563 |
| Bal.01 | B | >50 | 0.326 | 0.237 | 0.124 |
| BaL.26 | B | >50 | 1.10 | 0.214 | 0.060 |
| BG1168.01 | B | >50 | 4.06 | 1.42 | 0.738 |
| BL01.DG | B | >50 | >50 | >50 | >50 |
| BR07.DG | B | >50 | 4.66 | 1.51 | 1.81 |
| BX08.16 | B | >50 | >50 | 2.35 | 0.389 |
| CAAN.A2 | B | >50 | 7.47 | 2.23 | 0.963 |

Figure 54 cont.

| | | | | | |
|---|---|---|---|---|---|
| CNE10 | B | >50 | 23.2 | 5.26 | 0.689 |
| CNE12 | B | >50 | 8.19 | 2.56 | 0.695 |
| CNE14 | B | >50 | 12.5 | 0.594 | 0.199 |
| CNE4 | B | >50 | 5.97 | 1.16 | 0.639 |
| CNE57 | B | >50 | >50 | 1.25 | 0.496 |
| HO86.8 | B | >50 | 1.35 | 0.174 | >50 |
| HT593.1 | B | >50 | 2.23 | 0.984 | 0.606 |
| HXB2.DG | B | 18.1 | 0.243 | 0.173 | 0.063 |
| JRCSF.JB | B | >50 | 1.65 | 0.596 | 0.436 |
| JRFL.JB | B | 1.82 | 2.13 | 0.127 | 0.051 |
| MN.3 | B | >50 | 1.27 | 0.142 | 0.011 |
| PVO.04 | B | >50 | 3.53 | 1.47 | 0.552 |
| QH0515.01 | B | 26.4 | 7.95 | 1.40 | 1.43 |
| QH0692.42 | B | >50 | 10.8 | 2.25 | 1.37 |
| REJO.67 | B | >50 | >50 | 1.09 | 0.113 |
| RHPA.7 | B | 16.6 | 0.300 | 0.091 | 0.051 |
| SC422.8 | B | >50 | 3.73 | 0.798 | 0.127 |
| SF162.LS | B | >50 | 2.21 | 0.534 | 0.228 |
| SS1196.01 | B | >50 | >50 | 0.827 | 0.246 |
| THRO.18 | B | >50 | >50 | >50 | 4.63 |
| TRJO.58 | B | >50 | 1.76 | 0.524 | 0.116 |
| TRO.11 | B | 14.8 | 4.68 | 0.714 | 0.502 |
| WITO.33 | B | >50 | 3.65 | 0.418 | 0.140 |
| X2278.C2.B6 | B | >50 | 5.96 | 0.425 | 0.133 |
| YU2.DG | B | >50 | 0.761 | 0.235 | 0.113 |
| BJOX002000.03.2 | BC | >50 | 2.74 | 0.739 | >50 |
| CH038.12 | BC | >50 | >50 | 17.3 | 0.519 |
| CH070.1 | BC | >50 | >50 | 2.39 | 9.99 |
| CH117.4 | BC | >50 | 1.03 | 0.340 | 0.095 |
| CH119.10 | BC | >50 | 3.68 | 1.24 | 0.577 |
| CH181.12 | BC | >50 | 3.44 | 0.612 | 0.481 |

Figure 54 cont.

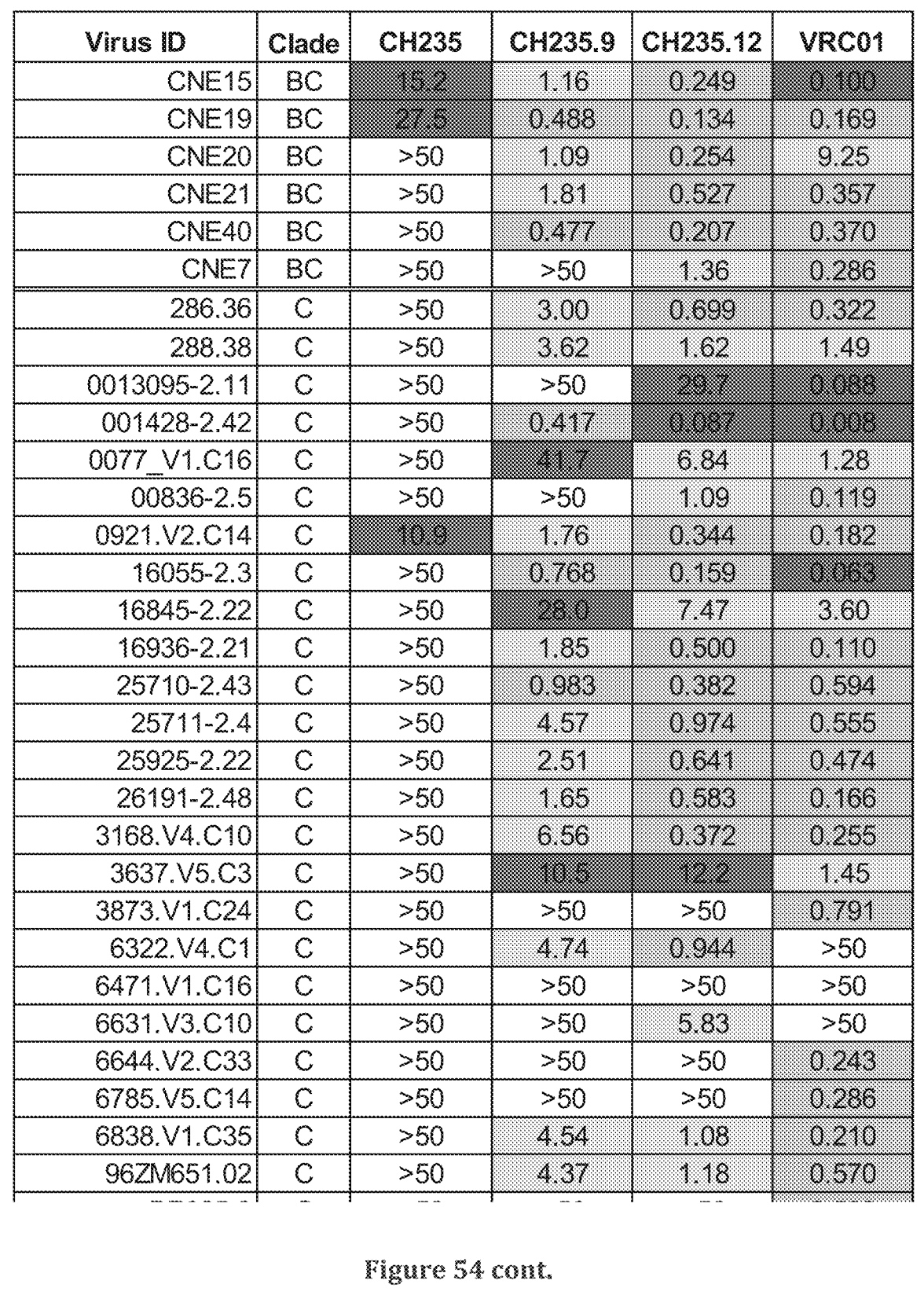

| Virus ID | Clade | CH235 | CH235.9 | CH235.12 | VRC01 |
|---|---|---|---|---|---|
| CNE15 | BC | 15.2 | 1.16 | 0.249 | 0.100 |
| CNE19 | BC | 27.5 | 0.488 | 0.134 | 0.169 |
| CNE20 | BC | >50 | 1.09 | 0.254 | 9.25 |
| CNE21 | BC | >50 | 1.81 | 0.527 | 0.357 |
| CNE40 | BC | >50 | 0.477 | 0.207 | 0.370 |
| CNE7 | BC | >50 | >50 | 1.36 | 0.286 |
| 286.36 | C | >50 | 3.00 | 0.699 | 0.322 |
| 288.38 | C | >50 | 3.62 | 1.62 | 1.49 |
| 0013095-2.11 | C | >50 | >50 | 29.7 | 0.088 |
| 001428-2.42 | C | >50 | 0.417 | 0.087 | 0.008 |
| 0077_V1.C16 | C | >50 | 41.7 | 6.84 | 1.28 |
| 00836-2.5 | C | >50 | >50 | 1.09 | 0.119 |
| 0921.V2.C14 | C | 10.9 | 1.76 | 0.344 | 0.182 |
| 16055-2.3 | C | >50 | 0.768 | 0.159 | 0.063 |
| 16845-2.22 | C | >50 | 28.0 | 7.47 | 3.60 |
| 16936-2.21 | C | >50 | 1.85 | 0.500 | 0.110 |
| 25710-2.43 | C | >50 | 0.983 | 0.382 | 0.594 |
| 25711-2.4 | C | >50 | 4.57 | 0.974 | 0.555 |
| 25925-2.22 | C | >50 | 2.51 | 0.641 | 0.474 |
| 26191-2.48 | C | >50 | 1.65 | 0.583 | 0.166 |
| 3168.V4.C10 | C | >50 | 6.56 | 0.372 | 0.255 |
| 3637.V5.C3 | C | >50 | 10.5 | 12.2 | 1.45 |
| 3873.V1.C24 | C | >50 | >50 | >50 | 0.791 |
| 6322.V4.C1 | C | >50 | 4.74 | 0.944 | >50 |
| 6471.V1.C16 | C | >50 | >50 | >50 | >50 |
| 6631.V3.C10 | C | >50 | >50 | 5.83 | >50 |
| 6644.V2.C33 | C | >50 | >50 | >50 | 0.243 |
| 6785.V5.C14 | C | >50 | >50 | >50 | 0.286 |
| 6838.V1.C35 | C | >50 | 4.54 | 1.08 | 0.210 |
| 96ZM651.02 | C | >50 | 4.37 | 1.18 | 0.570 |

Figure 54 cont.

| | | | | | |
|---|---|---|---|---|---|
| BR025.9 | C | >50 | >50 | >50 | 0.593 |
| CAP210.E8 | C | >50 | >50 | >50 | >50 |
| CAP244.D3 | C | >50 | 13.2 | 1.52 | 1.33 |
| CAP256.206.C9 | C | 14.6 | 3.73 | 1.32 | 0.971 |
| CAP45.G3 | C | >50 | 4.00 | 0.568 | 7.00 |
| Ce1176.A3 | C | >50 | 7.71 | 1.24 | 2.60 |
| CE703010217.B6 | C | >50 | 1.70 | 0.319 | 0.366 |
| CNE30 | C | >50 | 4.31 | 1.21 | 0.525 |
| CNE31 | C | >50 | >50 | 2.78 | 0.786 |
| CNE53 | C | 1.77 | 0.781 | 0.274 | 0.087 |
| CNE58 | C | >50 | >50 | 1.95 | 0.225 |
| DU123.06 | C | >50 | 17.5 | 4.25 | 7.92 |
| DU151.02 | C | 3.94 | 1.33 | 0.287 | 14.8 |
| DU156.12 | C | 9.48 | 1.65 | 0.285 | 0.086 |
| DU172.17 | C | 1.92 | 1.74 | 0.361 | >50 |
| DU422.01 | C | >50 | 2.85 | 0.944 | >50 |
| MW965.26 | C | 6.10 | 3.03 | 0.573 | 0.029 |
| SO18.18 | C | >50 | 1.24 | 0.110 | 0.058 |
| TV1.29 | C | >50 | 11.0 | 4.63 | >50 |
| TZA125.17 | C | >50 | >50 | >50 | >50 |
| TZBD.02 | C | >50 | 38.9 | 0.219 | 0.078 |
| ZA012.29 | C | 13.2 | 11.5 | 0.971 | 0.384 |
| ZM106.9 | C | >50 | 2.09 | 0.620 | 0.311 |
| ZM109.4 | C | >50 | 2.50 | 0.416 | 0.177 |
| ZM135.10a | C | >50 | >50 | >50 | 2.25 |
| ZM176.66 | C | >50 | 1.21 | 0.183 | 0.083 |
| ZM197.7 | C | >50 | 10.5 | 1.40 | 0.428 |
| ZM214.15 | C | >50 | 10.1 | 2.22 | 0.893 |
| ZM215.8 | C | 6.19 | 1.71 | 0.315 | 0.215 |
| ZM233.6 | C | 5.71 | 5.02 | 1.25 | 1.02 |

| Virus ID | Clade | CH235 | CH235.9 | CH235.12 | VRC01 |
|---|---|---|---|---|---|
| ZM249.1 | C | 9.99 | 0.598 | 0.273 | 0.057 |
| ZM53.12 | C | >50 | 4.44 | 0.558 | 0.625 |
| ZM55.28a | C | >50 | 4.20 | 0.665 | 0.285 |
| 3326.V4.C3 | CD | >50 | 1.54 | 0.114 | 0.068 |
| 3337.V2.C6 | CD | >50 | 10.8 | 0.429 | 0.090 |
| 3817.v2.c59 | CD | >50 | 14.6 | 3.63 | >50 |
| 231965.c1 | D | >50 | >50 | 13.9 | 0.353 |
| 247-23 | D | >50 | 3.32 | 0.691 | 1.84 |
| 3016.v5.c45 | D | >50 | >50 | >50 | 0.155 |
| 57128.vrc15 | D | >50 | >50 | 6.59 | >50 |
| 6405.v4.c34 | D | >50 | >50 | >50 | 1.55 |
| A03349M1.vrc4a | D | >50 | 7.54 | 4.08 | 4.10 |
| A07412M1.vrc12 | D | >50 | | 0.351 | 0.082 |
| NKU3006.ec1 | D | 4.61 | 1.29 | 0.466 | 0.596 |
| P0402.c2.11 | G | | 3.65 | | |
| P1981.C5.3 | G | >50 | >50 | 2.19 | 0.330 |
| X1193.c1 | G | >50 | 4.08 | 0.972 | 0.154 |
| X1254.c3 | G | >50 | >50 | 1.98 | 0.059 |
| X1632.S2.B10 | G | >50 | 1.18 | 0.484 | 0.130 |
| X2088.c9 | G | >50 | >50 | >50 | >50 |
| X2131.C1.B5 | G | >50 | 10.3 | 2.58 | 0.537 |
| SIVmac251.30.SG3 | NA | >50 | >50 | >50 | >50 |
| SVA.MLV | NA | >50 | >50 | >50 | >50 |

| | CH235 | CH235.9 | CH235.12 | VRC01 |
|---|---|---|---|---|
| **# Viruses** | 202 | 202 | 202 | 202 |
| **Total VS Neutralized** | | | | |
| **IC50 <50 μg/ml** | 35 | 153 | 179 | 179 |
| **IC50 <10 μg/ml** | 19 | 130 | 173 | 177 |
| **IC50 <1.0 μg/ml** | 2 | 25 | 115 | 146 |
| **IC50 <0.1 μg/ml** | 0 | 0 | 10 | 47 |
| **IC50 <0.01 μg/ml** | 0 | 0 | 0 | 1 |
| **% VS Neutralized** | | | | |
| **IC50 <50 μg/ml** | 17 | 76 | 89 | 89 |

Figure 54 cont.

| Complex (antibody-gp120) | CH235-93TH057 | CH235.9-93TH057 | CH235.12-93TH057 |
|---|---|---|---|
| **PDB ID** | 5F9W | 5F9O | 5F96 |
| **Data collection** | | | |
| Space group | $P3_2$ | $P\ 2_1\ 2_1\ 2_1$ | $P\ 2_1$ |
| Cell dimensions | | | |
| *a*, *b*, *c* (Å) | 123.4, 123.4, 127.3 | 63.5, 67.8, 225.6 | 53.7, 69.9, 127.3 |
| $\alpha$, $\beta$, $\gamma$ (°) | 90.0, 90.0, 120.0 | 90.0, 90.0, 90.0 | 90.0, 94.6, 90.0 |
| Resolution (Å) | 40.94-2.89 (2.99-2.89)* | 50.0-1.86 (2.00-1.93; 1.93-1.86) | 2.25 (2.29-2.25) |
| $R_{sym}$ or $R_{merge}$ | 0.22 (0.68) | 14.1 (41.8; 48.4) | 12.5 (41.4) |
| $I/\sigma I$ | 8.9 (1.9) | 7.06 (1.79; 1.25) | 15.5 (2.1) |
| Completeness (%) | 100 (100) | 89.7 (73.4; 46.8) | 97.6 (86.7) |
| Redundancy | 7.6 (6.7) | 3.4 (1.6; 1.2) | 3.0 (2.1) |
| | | | |
| **Refinement** | | | |
| Resolution (Å) | 40.9 – 2.89 | 35.8-1.86 | 34.5-2.25 |
| No. reflections | 48360 | 73935 | 43920 |
| $R_{work}/R_{free}$ | 17.5/22.9 | 20.4/22.0 | 18.3/23.0 |

Figure 55

| Complex (antibody-gp120) | CH235-93TH057 | CH235.9-93TH057 | CH235.12-93TH057 |
|---|---|---|---|
| No. atoms | | | |
| Protein | 11932 | 6137 | 5976 |
| Ligand/ion | 393 | 53 | 213 |
| Water | 74 | 461 | 196 |
| B-factors (Å$^2$) | | | |
| Protein | 92.5 | 43.5 | 63.4 |
| Ligand/ion | 120.9 | 87.0 | 103.4 |
| Water | 77.5 | 47.2 | 59.3 |
| R.m.s deviations | | | |
| Bond lengths (Å) | 0.004 | 0.008 | 0.006 |
| Bond angles (°) | 0.78 | 1.27 | 0.92 |
| Ramachandran statistics | | | |
| Favored (%) | 96.0 | 97.1 | 97.0 |
| Outliers (%) | 0.1 | 0.0 | 0.1 |

*Values in parenthesis denote highest resolution shell.

Figure 55 cont.

| Conforming antibody | # mutations ($x$) | Reference antibody | # sharing mutation positions ($c$) | Probability of seeing $c$ based on: Uniform distribution ($P_{uniform}$) | VH1-46 mutation frequencies ($P_{VH1-46}$) | PVH1-46/$P_{uniform}$ |
|---|---|---|---|---|---|---|
| CH235 | 15 | 1B2530 | 11 | 0.00432 | 0.17751 | 41.1 |
| CH235 | 15 | 8ANC131 | 13 | 0.00010 | 0.01744 | 174.4 |
| 1B2530 | 39 | 8ANC131 | 26 | 0.00001 | 0.04274 | 4274.0 |

Figure 56A

| Conforming antibody | # mutations ($x$) | Reference antibody | # identical mutations ($i$) | Probability of seeing $i$ based on: Uniform distribution ($P_{uniform}$) | VH1-46 mutation frequencies ($P_{VH1-46}$) | PVH1-46/$P_{uniform}$ |
|---|---|---|---|---|---|---|
| CH235 | 15 | 1B2530 | 4 | 0.00022 | 0.10433 | 474.2 |
| CH235 | 15 | 8ANC131 | 4 | 0.00019 | 0.11546 | 607.7 |
| 1B2530 | 39 | 8ANC131 | 7 | 0.00001 | 0.14622 | 14622.0 |

Figure 56B

| | IGHV1-2 | IGHV1-46 | IGHV1-69 | IGHV3-23 | IGHV3-30 |
|---|---|---|---|---|---|
| **IGHV1-46** | 0.84 | | | | |
| **IGHV1-69** | 0.74 | 0.74 | | | |
| **IGHV3-23** | 0.54 | 0.63 | 0.68 | | |
| **IGHV3-30** | 0.53 | 0.57 | 0.62 | 0.83 | |
| **IGHV4-59** | 0.47 | 0.53 | 0.55 | 0.67 | 0.57 |

Figure 56C

| | UCA | IA4 | IA3 | IA2 | IA1 | CH240 | CH236 | CH235 | CH239 | CH241 |
|---|---|---|---|---|---|---|---|---|---|---|
| sCD4 | nb | nb | nb | nb | >100 | nb | nb | 26.3 | 92.6 | 2.6 |
| CH106 | nb | nb | nb | nb | 82.4 | 68.9 | 82.2 | 16.5 | 45.4 | 1.5 |

Figure 57A

| | CH235 | CH236 | CH239 | CH240 | CH241 | CH106 |
|---|---|---|---|---|---|---|
| CH106 | 4.3 | 6.8 | 4.6 | 2.3 | 14.3 | 2.5 |

Figure 57B

| Virus ID | Week | Neutralization IC50, μg/ml UCA | IA4 | IA3 | CH235.11 |
|---|---|---|---|---|---|
| T/F | | >50 | >50 | **5.22** | **2.19** |
| CH505.w4.10 | 4 | >50 | **20.51** | **1.02** | **0.12** |
| CH505.w4.26 | 4 | >50 | >50 | **3.67** | **1.59** |
| CH505.w4.3 | 4 | >50 | >50 | **1.65** | **9.58** |
| CH505.w8.e12 | 14 | >50 | >50 | **34.99** | **0.06** |
| CH505.w8.e21 | 14 | >50 | >50 | >50 | **5.52** |
| CH505.w8.e29 | 14 | >50 | >50 | **5.34** | **6.19** |
| CH505.w8.e34 | 14 | >50 | >50 | **4.84** | **7.07** |
| CH505.w8.e6 | 14 | >50 | >50 | **5.73** | **17.42** |
| CH505.w8.e3 | 14 | >50 | >50 | **6.28** | **27.80** |
| CH505.w8.e4 | 14 | >50 | >50 | **3.60** | **35.26** |
| CH505.w12.e4 | 20 | >50 | >50 | >50 | **2.66** |
| CH505.w12.e19 | 20 | >50 | >50 | **8.99** | >50 |
| CH505.w12.e25 | 20 | >50 | >50 | **8.54** | >50 |
| CH505.w12.e27 | 20 | >50 | >50 | **10.28** | >50 |
| CH505.w24.e5 | 30 | >50 | >50 | >50 | **2.08** |
| CH505.w24.e34 | 30 | >50 | >50 | >50 | **2.18** |
| CH505.w24.e37 | 30 | >50 | >50 | >50 | **3.56** |
| CH505.w24.e24 | 30 | >50 | >50 | **29.77** | >50 |
| CH505.w24.e28 | 30 | >50 | >50 | >50 | >50 |
| CH505.w24.e13 | 30 | >50 | >50 | >50 | >50 |
| CH505.w48.e6 | 53 | >50 | >50 | >50 | >50 |
| CH505.w48.e22 | 53 | >50 | >50 | >50 | >50 |
| CH505.w48.e13 | 53 | >50 | >50 | >50 | >50 |
| CH505.w48.e28 | 53 | >50 | >50 | >50 | >50 |
| CH505.w48.e11 | 53 | >50 | >50 | >50 | >50 |
| CH505.w48.e31 | 53 | >50 | >50 | >50 | >50 |
| CH505.w96.A5 | 100 | >50 | >50 | >50 | >50 |
| CH505.w96.B8 | 100 | >50 | >50 | >50 | >50 |
| CH505.w96.B6 | 100 | >50 | >50 | >50 | >50 |
| CH505.w96.A10 | 100 | >50 | >50 | >50 | >50 |
| CH505.w96.A3 | 100 | >50 | >50 | >50 | >50 |
| CH505.w96.B4 | 100 | >50 | >50 | >50 | >50 |
| CH0505.C.w136.e.B23 | 136 | >50 | >50 | >50 | >50 |
| CH0505.C.w136.e.B18 | 136 | >50 | >50 | >50 | >50 |
| CH0505.C.w136.e.B24 | 136 | >50 | >50 | >50 | >50 |

Figure 58

| | Neutralization IC50, μg/ml | | | | |
|---|---|---|---|---|---|
| Virus ID | IA2 | IA1 | CH240 | CH236 | CH235 |
| T/F | 0.97 | 0.91 | 0.94 | 0.61 | 0.63 |
| CH505.w4.10 | 0.24 | 0.20 | 0.15 | 0.10 | 0.10 |
| CH505.w4.26 | 1.36 | 0.32 | 0.67 | 0.78 | 0.46 |
| CH505.w4.3 | 0.35 | 0.30 | 0.25 | 0.40 | 0.11 |
| CH505.w8.e12 | 2.22 | 0.85 | 0.93 | 0.53 | 0.42 |
| CH505.w8.e21 | 38.08 | 0.79 | 0.58 | 0.96 | 0.38 |
| CH505.w8.e29 | 1.02 | 0.86 | 0.88 | 1.05 | 0.75 |
| CH505.w8.e34 | 0.94 | 0.84 | 0.89 | 1.09 | 0.52 |
| CH505.w8.e6 | 1.64 | 0.92 | 0.73 | 0.63 | 0.31 |
| CH505.w8.e3 | 1.40 | 0.79 | 1.05 | 0.75 | 0.49 |
| CH505.w8.e4 | 1.00 | 0.72 | 0.60 | 0.88 | 0.27 |
| CH505.w12.e4 | 47.61 | 0.94 | 1.00 | 1.81 | 0.65 |
| CH505.w12.e19 | 2.12 | 1.99 | 1.63 | 1.24 | 1.16 |
| CH505.w12.e25 | 1.69 | 1.85 | 1.41 | 0.85 | 1.08 |
| CH505.w12.e27 | 2.06 | 0.98 | 1.13 | 0.46 | 0.39 |
| CH505.w24.e5 | 7.72 | 1.83 | 2.08 | 0.58 | 0.80 |
| CH505.w24.e34 | 4.98 | 5.18 | 5.61 | 2.27 | 3.23 |
| CH505.w24.e37 | 6.45 | 6.92 | 7.57 | 2.60 | 4.25 |
| CH505.w24.e24 | 27.95 | 4.62 | 4.12 | 3.69 | 2.06 |
| CH505.w24.e28 | >50 | 5.28 | 5.28 | 9.14 | 2.16 |
| CH505.w24.e13 | >50 | 4.73 | 5.11 | 4.39 | 1.15 |
| CH505.w48.e6 | >50 | >50 | >50 | >50 | >50 |
| CH505.w48.e22 | >50 | >50 | >50 | >50 | >50 |
| CH505.w48.e13 | >50 | >50 | >50 | >50 | >50 |
| CH505.w48.e28 | >50 | >50 | >50 | >50 | >50 |
| CH505.w48.e11 | >50 | >50 | >50 | >50 | >50 |
| CH505.w48.e31 | >50 | >50 | >50 | >50 | >50 |
| CH505.w96.A5 | >50 | >50 | >50 | >50 | >50 |
| CH505.w96.B8 | >50 | >50 | >50 | >50 | >50 |
| CH505.w96.B6 | >50 | >50 | >50 | >50 | >50 |
| CH505.w96.A10 | >50 | >50 | >50 | >50 | >50 |
| CH505.w96.A3 | >50 | >50 | >50 | >50 | >50 |
| CH505.w96.B4 | >50 | >50 | >50 | >50 | >50 |
| CH0505.C.w136.e.B23 | >50 | >50 | >50 | >50 | >50 |
| CH0505.C.w136.e.B18 | >50 | >50 | >50 | >50 | >50 |
| CH0505.C.w136.e.B24 | >50 | >50 | >50 | >50 | >50 |

Figure 58 cont.

| | Neutralization IC50, µg/ml | | | | |
|---|---|---|---|---|---|
| Virus ID | CH239 | CH241 | CH235.7 | CH235.13 | CH235.10 |
| T/F | 0.48 | 0.14 | 0.39 | 0.91 | 0.22 |
| CH505.w4.10 | <0.02 | <0.02 | 0.07 | 0.17 | 0.10 |
| CH505.w4.26 | 0.30 | 0.05 | 0.09 | 0.16 | 0.04 |
| CH505.w4.3 | 0.10 | <0.02 | 0.06 | 0.15 | 0.11 |
| CH505.w8.e12 | 0.41 | 0.09 | 0.07 | 0.18 | 0.02 |
| CH505.w8.e21 | 0.14 | 0.04 | 0.10 | 0.17 | 0.24 |
| CH505.w8.e29 | 0.61 | 0.17 | 0.17 | 0.35 | 0.15 |
| CH505.w8.e34 | 0.78 | 0.12 | 0.14 | 0.31 | 0.12 |
| CH505.w8.e6 | 0.43 | 0.17 | 0.21 | 0.34 | 0.21 |
| CH505.w8.e3 | 0.40 | 0.09 | 0.19 | 0.27 | 0.24 |
| CH505.w8.e4 | 0.40 | 0.08 | 0.20 | 0.34 | 0.13 |
| CH505.w12.e4 | 0.18 | 0.06 | 0.08 | 0.19 | 0.18 |
| CH505.w12.e19 | 1.11 | 0.27 | 0.29 | 0.47 | 0.24 |
| CH505.w12.e25 | 0.75 | 0.18 | 0.29 | 0.37 | 0.23 |
| CH505.w12.e27 | 0.27 | 0.10 | 0.16 | 0.30 | 0.12 |
| CH505.w24.e5 | 0.67 | 1.17 | 0.35 | 0.38 | 0.44 |
| CH505.w24.e34 | 3.02 | 3.68 | 0.74 | 0.60 | 0.38 |
| CH505.w24.e37 | 2.79 | 3.99 | 0.94 | 1.19 | 0.43 |
| CH505.w24.e24 | 1.54 | 0.49 | 0.64 | 0.72 | 0.43 |
| CH505.w24.e28 | 2.07 | 0.40 | 0.11 | 0.53 | 45.05 |
| CH505.w24.e13 | 1.49 | 2.96 | 0.16 | 0.39 | >50 |
| CH505.w48.e6 | 19.95 | >50 | 1.76 | 2.66 | 3.69 |
| CH505.w48.e22 | >50 | >50 | 12.55 | 5.43 | 3.06 |
| CH505.w48.e13 | 33.78 | >50 | 27.04 | 5.03 | 2.42 |
| CH505.w48.e28 | >50 | >50 | 25.29 | 5.08 | 2.58 |
| CH505.w48.e11 | >50 | >50 | 34.23 | 3.26 | 3.10 |
| CH505.w48.e31 | >50 | >50 | >50 | 25.92 | 1.53 |
| CH505.w96.A5 | >50 | >50 | >50 | >50 | >50 |
| CH505.w96.B8 | >50 | >50 | >50 | >50 | >50 |
| CH505.w96.B6 | >50 | >50 | >50 | >50 | >50 |
| CH505.w96.A10 | >50 | >50 | >50 | >50 | >50 |
| CH505.w96.A3 | >50 | 45.37 | >50 | >50 | >50 |
| CH505.w96.B4 | 48.62 | 41.17 | >50 | >50 | >50 |
| CH0505.C.w136.e.B23 | >50 | >50 | >50 | 29.73 | 11.41 |
| CH0505.C.w136.e.B18 | >50 | >50 | >50 | 32.27 | 27.81 |
| CH0505.C.w136.e.B24 | >50 | >50 | >50 | >50 | 43.03 |

Figure 58 cont.

| | Neutralization IC50, µg/ml | |
|---|---|---|
| **Virus ID** | **CH235.9** | **CH235.12** |
| T/F | **0.51** | **0.22** |
| CH505.w4.10 | **0.08** | **<0.02** |
| CH505.w4.26 | **0.16** | **0.03** |
| CH505.w4.3 | **0.11** | **<0.02** |
| CH505.w8.e12 | **0.08** | **<0.02** |
| CH505.w8.e21 | **0.14** | **<0.02** |
| CH505.w8.e29 | **0.21** | **0.06** |
| CH505.w8.e34 | **0.16** | **0.05** |
| CH505.w8.e6 | **0.30** | **0.09** |
| CH505.w8.e3 | **0.25** | **0.11** |
| CH505.w8.e4 | **0.27** | **0.06** |
| CH505.w12.e4 | **0.08** | **<0.02** |
| CH505.w12.e19 | **0.27** | **0.05** |
| CH505.w12.e25 | **0.38** | **0.07** |
| CH505.w12.e27 | **0.15** | **0.05** |
| CH505.w24.e5 | **0.26** | **0.07** |
| CH505.w24.e34 | **0.62** | **0.12** |
| CH505.w24.e37 | **0.70** | **0.19** |
| CH505.w24.e24 | **0.67** | **0.17** |
| CH505.w24.e28 | **0.37** | **0.17** |
| CH505.w24.e13 | **0.46** | **0.10** |
| CH505.w48.e6 | **1.25** | **0.46** |
| CH505.w48.e22 | **1.30** | **0.58** |
| CH505.w48.e13 | **1.39** | **0.48** |
| CH505.w48.e28 | **1.23** | **0.66** |
| CH505.w48.e11 | **2.48** | **0.75** |
| CH505.w48.e31 | **1.44** | **0.11** |
| CH505.w96.A5 | >50 | **3.68** |
| CH505.w96.B8 | >50 | **3.02** |
| CH505.w96.B6 | >50 | **8.35** |
| CH505.w96.A10 | >50 | **19.82** |
| CH505.w96.A3 | >50 | >50 |
| CH505.w96.B4 | >50 | >50 |
| CH0505.C.w136.e.B23 | **10.23** | **1.75** |
| CH0505.C.w136.e.B18 | **12.41** | **3.33** |
| CH0505.C.w136.e.B24 | **13.58** | **4.09** |

Figure 58 cont.

| | | Neutralization IC50, µg/ml | | | |
|---|---|---|---|---|---|
| **Virus ID** | **Week** | **UCA** | **IA4** | **IA3** | **CH235.11** |
| CH0505.C.w136.e.B33 | 136 | >50 | >50 | >50 | >50 |
| CH0505.C.w136.e.B38 | 136 | >50 | >50 | >50 | >50 |
| CH0505.C.w136.e.B2 | 136 | >50 | >50 | >50 | >50 |
| CH0505.C.w136.e.B3 | 136 | >50 | >50 | >50 | >50 |
| CH0505.C.w136.e.B4 | 136 | >50 | >50 | >50 | >50 |
| CH0505.C.w136.e.B5 | 136 | >50 | >50 | >50 | >50 |
| CH0505.C.w136.e.B12 | 136 | >50 | >50 | >50 | >50 |
| CH0505.C.w136.e.B27 | 136 | >50 | >50 | >50 | >50 |
| CH0505.C.w160.C2 | 160 | >50 | >50 | >50 | >50 |
| CH0505.C.w24.C9 | 160 | >50 | >50 | >50 | >50 |
| CH0505.C.w24.C10 | 160 | >50 | >50 | >50 | >50 |
| CH0505.C.w24.C11 | 160 | >50 | >50 | >50 | >50 |
| CH0505.C.w24.C12 | 160 | >50 | >50 | >50 | >50 |
| CH0505.C.w24.D2 | 160 | >50 | >50 | >50 | >50 |
| CH0505.C.w24.T3 | 160 | >50 | >50 | >50 | >50 |
| CH0505.w176.e11 | 176 | >50 | >50 | >50 | >50 |
| CH0505.w176.e12 | 176 | >50 | >50 | >50 | >50 |
| CH0505.w176.e13 | 176 | >50 | >50 | >50 | >50 |
| CH0505.w176.e1 | 176 | >50 | >50 | >50 | >50 |
| CH0505.w176.e2 | 176 | >50 | >50 | >50 | >50 |
| CH0505.w176.e10 | 176 | >50 | >50 | >50 | >50 |
| CH0505.w233.e1 | 233 | >50 | >50 | >50 | >50 |
| CH0505.w233.e3 | 233 | >50 | >50 | >50 | >50 |
| CH0505.w233.e4 | 233 | >50 | >50 | >50 | >50 |
| CH0505.w233.e7 | 233 | >50 | >50 | >50 | >50 |
| CH0505.w233.e17 | 233 | >50 | >50 | >50 | >50 |
| CH0505.w233.e18 | 233 | >50 | >50 | >50 | >50 |
| CH0505.w258.e4 | 258 | >50 | >50 | **34.10** | >50 |
| CH0505.w258.e1 | 258 | >50 | >50 | >50 | >50 |
| CH0505.w258.e7 | 258 | >50 | >50 | >50 | >50 |
| CH0505.w258.e6 | 258 | >50 | >50 | >50 | >50 |
| CH0505.w258.e5 | 258 | >50 | >50 | >50 | >50 |
| CH0505.w323.e1 | 323 | >50 | >50 | >50 | >50 |
| CH0505.w323.e11 | 323 | >50 | >50 | >50 | >50 |
| CH0505.w323.e13 | 323 | >50 | >50 | >50 | >50 |
| CH0505.w323.e14 | 323 | >50 | >50 | >50 | >50 |
| CH0505.w323.e15 | 323 | >50 | >50 | >50 | >50 |
| CH0505.w323.e16 | 323 | >50 | >50 | >50 | >50 |
| CH0505.w323.e17 | 323 | >50 | >50 | >50 | >50 |
| CH0505.w323.e18 | 323 | >50 | >50 | >50 | >50 |

Figure 58 cont.

| | Neutralization IC50, µg/ml | | | | |
|---|---|---|---|---|---|
| | IA2 | IA1 | CH240 | CH236 | CH235 |
| CH0505.C.w136.e.B33 | >50 | >50 | >50 | >50 | >50 |
| CH0505.C.w136.e.B38 | >50 | >50 | >50 | >50 | >50 |
| CH0505.C.w136.e.B2 | >50 | >50 | >50 | >50 | >50 |
| CH0505.C.w136.e.B3 | >50 | >50 | >50 | >50 | >50 |
| CH0505.C.w136.e.B4 | >50 | >50 | >50 | >50 | >50 |
| CH0505.C.w136.e.B5 | >50 | >50 | >50 | >50 | >50 |
| CH0505.C.w136.e.B12 | >50 | >50 | >50 | >50 | >50 |
| CH0505.C.w136.e.B27 | >50 | >50 | >50 | >50 | >50 |
| CH0505.C.w160.C2 | >50 | >50 | >50 | >50 | >50 |
| CH0505.C.w24.C9 | >50 | >50 | >50 | >50 | >50 |
| CH0505.C.w24.C10 | >50 | >50 | >50 | >50 | >50 |
| CH0505.C.w24.C11 | >50 | >50 | >50 | >50 | >50 |
| CH0505.C.w24.C12 | >50 | >50 | >50 | >50 | >50 |
| CH0505.C.w24.D2 | >50 | >50 | >50 | >50 | >50 |
| CH0505.C.w24.T3 | >50 | >50 | >50 | >50 | >50 |
| CH0505.w176.e11 | >50 | >50 | >50 | >50 | >50 |
| CH0505.w176.e12 | >50 | >50 | >50 | >50 | >50 |
| CH0505.w176.e13 | >50 | >50 | >50 | >50 | >50 |
| CH0505.w176.e1 | >50 | >50 | >50 | >50 | >50 |
| CH0505.w176.e2 | >50 | >50 | >50 | >50 | >50 |
| CH0505.w176.e10 | >50 | >50 | >50 | >50 | >50 |
| CH0505.w233.e1 | >50 | >50 | >50 | >50 | >50 |
| CH0505.w233.e3 | >50 | >50 | >50 | >50 | >50 |
| CH0505.w233.e4 | >50 | >50 | >50 | >50 | >50 |
| CH0505.w233.e7 | >50 | >50 | >50 | >50 | >50 |
| CH0505.w233.e17 | >50 | >50 | >50 | >50 | >50 |
| CH0505.w233.e18 | >50 | >50 | >50 | >50 | >50 |
| CH0505.w258.e4 | >50 | >50 | >50 | >50 | >50 |
| CH0505.w258.e1 | >50 | >50 | >50 | >50 | >50 |
| CH0505.w258.e7 | >50 | >50 | >50 | >50 | >50 |
| CH0505.w258.e6 | >50 | >50 | >50 | >50 | >50 |
| CH0505.w258.e5 | >50 | >50 | >50 | >50 | >50 |
| CH0505.w323.e1 | >50 | >50 | >50 | >50 | >50 |
| CH0505.w323.e11 | >50 | >50 | >50 | >50 | >50 |
| CH0505.w323.e13 | >50 | >50 | >50 | >50 | >50 |
| CH0505.w323.e14 | >50 | >50 | >50 | >50 | >50 |
| CH0505.w323.e15 | >50 | >50 | >50 | >50 | >50 |
| CH0505.w323.e16 | >50 | >50 | >50 | >50 | >50 |
| CH0505.w323.e17 | >50 | >50 | >50 | >50 | >50 |
| CH0505.w323.e18 | >50 | >50 | >50 | >50 | >50 |

Figure 58 cont.

| | Neutralization IC50, μg/ml | | | | |
|---|---|---|---|---|---|
| | **CH239** | **CH241** | **CH235.7** | **CH235.13** | **CH235.10** |
| CH0505.C.w136.e.B33 | >50 | >50 | >50 | >50 | **32.79** |
| CH0505.C.w136.e.B38 | >50 | >50 | >50 | >50 | **32.68** |
| CH0505.C.w136.e.B2 | >50 | >50 | >50 | >50 | >50 |
| CH0505.C.w136.e.B3 | >50 | >50 | >50 | >50 | >50 |
| CH0505.C.w136.e.B4 | >50 | >50 | >50 | >50 | >50 |
| CH0505.C.w136.e.B5 | >50 | >50 | >50 | >50 | >50 |
| CH0505.C.w136.e.B12 | >50 | >50 | >50 | >50 | >50 |
| CH0505.C.w136.e.B27 | >50 | >50 | >50 | >50 | >50 |
| CH0505.C.w160.C2 | >50 | >50 | >50 | >50 | >50 |
| CH0505.C.w24.C9 | >50 | >50 | >50 | >50 | >50 |
| CH0505.C.w24.C10 | >50 | >50 | >50 | >50 | >50 |
| CH0505.C.w24.C11 | >50 | >50 | >50 | >50 | >50 |
| CH0505.C.w24.C12 | >50 | >50 | >50 | >50 | >50 |
| CH0505.C.w24.D2 | >50 | >50 | >50 | >50 | >50 |
| CH0505.C.w24.T3 | >50 | >50 | >50 | >50 | >50 |
| CH0505.w176.e11 | >50 | >50 | >50 | >50 | >50 |
| CH0505.w176.e12 | >50 | >50 | >50 | >50 | >50 |
| CH0505.w176.e13 | >50 | >50 | >50 | >50 | >50 |
| CH0505.w176.e1 | >50 | >50 | >50 | >50 | >50 |
| CH0505.w176.e2 | >50 | >50 | >50 | >50 | >50 |
| CH0505.w176.e10 | >50 | >50 | >50 | >50 | >50 |
| CH0505.w233.e1 | >50 | >50 | >50 | >50 | >50 |
| CH0505.w233.e3 | >50 | >50 | >50 | >50 | >50 |
| CH0505.w233.e4 | >50 | >50 | >50 | >50 | >50 |
| CH0505.w233.e7 | >50 | >50 | >50 | >50 | >50 |
| CH0505.w233.e17 | >50 | >50 | >50 | >50 | >50 |
| CH0505.w233.e18 | >50 | >50 | >50 | >50 | >50 |
| CH0505.w258.e4 | >50 | >50 | >50 | >50 | >50 |
| CH0505.w258.e1 | >50 | >50 | >50 | >50 | >50 |
| CH0505.w258.e7 | >50 | >50 | >50 | >50 | >50 |
| CH0505.w258.e6 | >50 | >50 | >50 | >50 | >50 |
| CH0505.w258.e5 | >50 | >50 | >50 | >50 | >50 |
| CH0505.w323.e1 | >50 | >50 | >50 | >50 | >50 |
| CH0505.w323.e11 | >50 | >50 | >50 | >50 | >50 |
| CH0505.w323.e13 | >50 | >50 | >50 | >50 | >50 |
| CH0505.w323.e14 | >50 | >50 | >50 | >50 | >50 |
| CH0505.w323.e15 | >50 | >50 | >50 | >50 | >50 |
| CH0505.w323.e16 | >50 | >50 | >50 | >50 | >50 |
| CH0505.w323.e17 | >50 | >50 | >50 | >50 | >50 |
| CH0505.w323.e18 | >50 | >50 | >50 | >50 | >50 |

Figure 58 cont.

| | Neutralization IC50, µg/ml | |
|---|---|---|
| | **CH235.9** | **CH235.12** |
| CH0505.C.w136.e.B33 | **16.05** | **3.62** |
| CH0505.C.w136.e.B38 | **16.17** | **3.88** |
| CH0505.C.w136.e.B2 | **28.62** | **5.95** |
| CH0505.C.w136.e.B3 | >50 | >50 |
| CH0505.C.w136.e.B4 | >50 | >50 |
| CH0505.C.w136.e.B5 | >50 | >50 |
| CH0505.C.w136.e.B12 | >50 | >50 |
| CH0505.C.w136.e.B27 | >50 | >50 |
| CH0505.C.w160.C2 | >50 | >50 |
| CH0505.C.w24.C9 | >50 | >50 |
| CH0505.C.w24.C10 | >50 | >50 |
| CH0505.C.w24.C11 | >50 | >50 |
| CH0505.C.w24.C12 | >50 | >50 |
| CH0505.C.w24.D2 | >50 | >50 |
| CH0505.C.w24.T3 | >50 | >50 |
| CH0505.w176.e11 | >50 | **15.43** |
| CH0505.w176.e12 | >50 | **26.20** |
| CH0505.w176.e13 | >50 | **30.25** |
| CH0505.w176.e1 | >50 | **35.54** |
| CH0505.w176.e2 | >50 | **26.11** |
| CH0505.w176.e10 | >50 | >50 |
| CH0505.w233.e1 | >50 | >50 |
| CH0505.w233.e3 | >50 | >50 |
| CH0505.w233.e4 | >50 | >50 |
| CH0505.w233.e7 | >50 | >50 |
| CH0505.w233.e17 | >50 | >50 |
| CH0505.w233.e18 | >50 | >50 |
| CH0505.w258.e4 | >50 | >50 |
| CH0505.w258.e1 | >50 | >50 |
| CH0505.w258.e7 | >50 | >50 |
| CH0505.w258.e6 | >50 | >50 |
| CH0505.w258.e5 | >50 | >50 |
| CH0505.w323.e1 | >50 | >50 |
| CH0505.w323.e11 | >50 | >50 |
| CH0505.w323.e13 | >50 | >50 |
| CH0505.w323.e14 | >50 | >50 |
| CH0505.w323.e15 | >50 | >50 |
| CH0505.w323.e16 | >50 | >50 |
| CH0505.w323.e17 | >50 | >50 |
| CH0505.w323.e18 | >50 | >50 |

Figure 58 cont.

Neutralization IC50, μg/ml

| Virus ID | Virus Mutations | CH236 | CH235.7 | CH235.10 | CH235.11 | CH235.13 | CH235.12 |
|---|---|---|---|---|---|---|---|
| CH505.TF | - | 0.61 | 0.39 | 0.22 | 2.19 | 0.91 | 0.22 |
| CH505.TF.M5 | N279K | 0.26 | 0.16 | 0.17 | 0.31 | 0.18 | 0.02 |
| CH505.TF.M6 | V281A | 0.80 | 0.34 | 0.11 | 2.30 | 0.30 | 0.08 |
| CH505.TF.M10 | V281G | 1.75 | 0.18 | 0.19 | 1.52 | 0.14 | 0.02 |
| CH505.TF.M19 | V281D | 7.53 | 0.40 | >50 | >50 | 0.57 | 0.17 |
| CH505.TF.M11 | N279D+V281A | >50 | 0.50 | 0.21 | 15.35 | 0.25 | 0.08 |
| CH505.TF.M8 | N280S+V281A | >50 | >50 | >50 | 1.91 | 0.86 | 0.05 |
| CH505.TF.M21 | N280T+V281A | >50 | >50 | >50 | 10.16 | 16.72 | 0.13 |
| CH505.TF.M20 | N280S+V281G | >50 | >50 | >50 | 7.86 | 11.58 | 0.07 |
| CH505.TF.M7 | E275K+N279D+V281S | >50 | >50 | 0.61 | >50 | 2.12 | 0.13 |
| CH505.TF.M9 | E275K+N279D+V281G | >50 | >50 | 0.24 | 0.46 | 5.02 | 0.11 |

Figure 59

Neutralization IC50, μg/ml

| Virus ID | Virus Mutations | CH235.9 | CH235.9 N30T | CH235.9 D31T | CH235.9 G62Q | CH235.9 G65Q | G62Q+ G65Q | CH235.9 A103E |
|---|---|---|---|---|---|---|---|---|
| CH505.TF | - | 0.51 | 4.26 | 0.43 | 0.30 | 0.26 | 0.15 | 0.43 |
| CH505.TF.M5 | N279K | 0.19 | 0.90 | 0.11 | 0.12 | 0.14 | 0.12 | 0.03 |
| CH505.TF.M6 | V281A | 0.40 | 1.06 | 0.12 | 0.02 | 0.08 | 0.04 | 0.16 |
| CH505.TF.M10 | V281G | 0.24 | 0.83 | 0.07 | 0.02 | 0.09 | 0.08 | 0.07 |
| CH505.TF.M19 | V281D | 0.63 | 4.04 | 0.89 | 1.36 | 1.58 | 1.54 | 0.43 |
| CH505.TF.M11 | N279D+V281A | 0.39 | 1.25 | 0.12 | 0.02 | 0.14 | 0.13 | 0.24 |
| CH505.TF.M8 | N280S+V281A | 0.66 | 24.31 | 0.15 | 0.14 | 0.12 | 0.03 | 0.13 |
| CH505.TF.M21 | N280T+V281A | 0.74 | >50 | 0.23 | 0.15 | 0.25 | 0.27 | 0.19 |
| CH505.TF.M20 | N280S+V281G | 0.94 | 44.29 | 0.08 | 0.11 | 0.26 | 0.26 | 0.10 |
| CH505.TF.M7 | E275K+N279D+V281S | 0.77 | 44.21 | 0.38 | 0.37 | 0.49 | 0.38 | 0.19 |
| CH505.TF.M9 | E275K+N279D+V281G | 0.85 | 42.75 | 0.25 | 0.25 | 0.24 | 0.14 | 0.14 |

Figure 59 cont.

| | | CH235 Lineage | | | | | | | | | | | | | | | |
|---|---|---|---|---|---|---|---|---|---|---|---|---|---|---|---|---|---|
| | Envelope ID | UCA | IA4 | IA3 | IA2 | CH240 | CH236 | CH239 | IA1 | CH235.7 | CH235.10 | CH235.11 | CH235.13 | CH235 | CH241 | CH235.9 | CH235.12 |
| | CH0505_CON D7gp120/293i | 0.00 | 0.00 | 5.09 | 4.77 | 5.26 | 6.89 | 8.74 | 6.89 | 9.64 | 7.23 | 0.26 | 6.23 | 9.73 | 13.27 | 8.67 | 8.39 |
| Week 4 | CH505w004.10D8gp120/293F | 0.26 | 0.00 | 6.55 | 6.25 | 6.47 | 8.10 | 12.11 | 8.53 | 10.31 | 2.64 | 1.17 | 7.63 | 10.88 | 14.01 | 8.78 | 9.10 |
| Week 4 | CH505.w4.26D8gp120 /293F | 0.00 | 0.35 | 4.65 | 4.41 | 4.66 | 6.71 | 8.39 | 6.77 | 9.78 | 6.40 | 0.24 | 5.67 | 9.85 | 13.34 | 8.09 | 7.69 |
| Week 4 | 505.s.03.D8.gp120/293F | 0.00 | 0.00 | 5.13 | 5.03 | 5.33 | 6.90 | 8.82 | 7.39 | 10.68 | 7.20 | 0.36 | 6.32 | 10.26 | 13.88 | 8.44 | 8.23 |
| Week 14 | CH505w014.8D8gp120 | 0.00 | 0.16 | 3.13 | 2.68 | 3.19 | 5.93 | 6.98 | 5.49 | 8.17 | 4.48 | 0.00 | 4.62 | 9.07 | 12.73 | 5.08 | 6.31 |
| Week 14 | CH505w014.2D8gp120/293F | 0.00 | 0.00 | 3.49 | 3.01 | 3.53 | 5.87 | 7.27 | 5.82 | 8.66 | 5.49 | 0.12 | 5.52 | 9.02 | 12.59 | 7.08 | 6.44 |
| Week 14 | CH505w014.32D8gp120/293F | 0.00 | 0.00 | 4.72 | 4.51 | 4.58 | 6.47 | 8.39 | 6.63 | 9.68 | 6.33 | 0.26 | 5.57 | 10.62 | 13.47 | 7.86 | 7.63 |
| Week 14 | CH505w014.3D8gp120 | 0.00 | 0.00 | 4.25 | 4.12 | 4.57 | 6.02 | 7.83 | 6.56 | 9.61 | 6.63 | 0.31 | 6.24 | 9.62 | 12.99 | 8.06 | 8.04 |
| Week 14 | CH505.08.D11gp120/293F | 0.00 | 0.00 | 3.45 | 3.01 | 3.24 | 5.00 | 7.20 | 5.52 | 7.81 | 4.07 | 0.00 | 4.43 | 8.19 | 11.69 | 6.20 | 6.26 |
| Week 14 | CH505w014.10D8gp120 | 0.00 | 0.00 | 0.00 | 0.00 | 1.92 | 4.24 | 9.83 | 5.57 | 8.95 | 0.85 | 0.26 | 5.89 | 9.43 | 13.26 | 8.74 | 8.00 |
| Week 14 | CH505w014.21D8gp120/293F | 0.00 | 0.00 | 0.00 | 0.00 | 3.00 | 4.89 | 11.21 | 6.59 | 9.95 | 1.29 | 0.26 | 5.81 | 10.58 | 14.40 | 9.70 | 7.95 |
| Week 20 | CH505w020.15D8gp120 | 0.00 | 0.14 | 4.94 | 5.35 | 4.80 | 6.82 | 8.52 | 6.84 | 9.90 | 6.79 | 0.38 | 6.28 | 9.99 | 13.40 | 8.44 | 7.81 |
| Week 20 | CH505w020.13D8gp120 | 0.08 | 0.00 | 3.87 | 3.56 | 3.49 | 5.68 | 7.15 | 5.85 | 8.93 | 6.30 | 0.30 | 5.54 | 8.63 | 12.19 | 7.29 | 7.31 |
| Week 20 | CH505w020.22D8gp120/293F | 0.00 | 0.00 | 4.68 | 4.24 | 2.92 | 6.70 | 8.31 | 6.55 | 10.37 | 6.77 | 0.33 | 6.01 | 9.86 | 13.58 | 8.70 | 7.97 |
| Week 20 | CH505w020.14D8gp120 | 0.00 | 0.00 | 2.72 | 1.22 | 3.83 | 6.72 | 9.01 | 6.52 | 9.35 | 5.63 | 0.11 | 6.14 | 9.91 | 13.08 | 8.15 | 8.33 |
| Week 20 | CH505w020.8D8gp120/293F | 0.00 | 0.00 | 2.16 | 2.33 | 3.17 | 6.27 | 9.38 | 6.04 | 9.54 | 4.73 | 0.22 | 5.19 | 10.09 | 13.36 | 8.19 | 7.31 |
| Week 20 | CH505w020.3D8gp120 | 0.00 | 0.00 | 2.00 | 0.76 | 2.32 | 5.80 | 8.18 | 5.32 | 8.34 | 3.80 | 0.10 | 4.93 | 9.61 | 12.83 | 6.91 | 6.61 |
| Week 20 | CH505w020.30D8gp120 | 0.00 | 0.00 | 1.40 | 0.52 | 1.85 | 4.50 | 7.51 | 4.72 | 7.63 | 4.07 | 0.09 | 4.36 | 8.59 | 12.34 | 6.56 | 6.41 |
| Week 20 | CH505w020.23D8gp120 | 0.00 | 0.00 | 2.57 | 1.09 | 2.85 | 4.95 | 8.93 | 5.89 | 8.65 | 4.12 | 0.09 | 5.03 | 9.84 | 13.45 | 8.07 | 6.73 |
| Week 20 | CH505w020.11D8gp120 | 0.00 | 0.00 | 2.21 | 1.59 | 2.11 | 4.89 | 6.14 | 4.40 | 7.04 | 2.77 | 0.00 | 3.98 | 7.81 | 11.65 | 4.49 | 5.52 |
| Week 20 | CH505w020.9D8gp120 | 0.00 | 0.00 | 1.67 | 0.52 | 2.20 | 5.60 | 7.81 | 5.02 | 7.88 | 2.86 | 0.07 | 3.99 | 8.95 | 12.06 | 6.33 | 6.28 |
| Week 20 | CH505w020.4D8gp120/293F | 0.00 | 0.00 | 0.00 | 1.69 | 2.64 | 5.67 | 10.28 | 7.07 | 9.92 | 1.82 | 0.39 | 6.33 | 9.75 | 13.59 | 9.79 | 8.66 |
| Week 20 | CH505w020.7D8gp120 | 0.00 | 0.00 | 0.00 | 0.00 | 3.06 | 5.38 | 10.27 | 6.45 | 9.47 | 1.36 | 0.27 | 6.63 | 9.63 | 13.32 | 9.59 | 8.85 |
| Week 20 | CH505w020.26D8gp120 | 0.00 | 0.00 | 0.00 | 0.00 | 1.64 | 4.14 | 9.23 | 5.37 | 7.96 | 0.56 | 0.11 | 4.53 | 8.58 | 12.68 | 7.80 | 7.06 |

Figure 60

| | | CH235 Lineage | | | | | | | | | | | | | | | |
|---|---|---|---|---|---|---|---|---|---|---|---|---|---|---|---|---|---|
| | Envelope ID | UCA | IA4 | IA3 | IA2 | CH240 | CH236 | CH239 | IA1 | CH235.7 | CH235.10 | CH235.11 | CH235.13 | CH235 | CH241 | CH235.9 | CH235.12 |
| Week 30 | CH505w030.6D8gp120/293F | 0.44 | 0.00 | 0.09 | 1.44 | 2.06 | 6.61 | 8.00 | 5.31 | 8.45 | 2.28 | 0.19 | 4.49 | 8.57 | 7.54 | 7.67 | 6.86 |
| | CH505w030.36D8gp120 | 0.56 | 0.00 | 1.03 | 0.55 | 1.21 | 4.82 | 5.51 | 3.43 | 7.60 | 3.34 | 0.28 | 4.53 | 7.01 | 5.74 | 7.02 | 7.21 |
| | CH505.w30.12D8gp140 | 0.32 | 0.00 | 0.00 | 0.10 | 0.00 | 0.54 | 2.04 | 1.02 | 2.26 | 0.08 | 0.14 | 0.97 | 5.05 | 7.32 | 2.11 | 1.80 |
| | CH505w030.20D8gp120/293F | 0.00 | 0.24 | 1.16 | 0.53 | 1.53 | 6.23 | 8.02 | 4.82 | 8.82 | 5.62 | 0.69 | 5.41 | 8.33 | 8.03 | 8.09 | 8.59 |
| | CH505w030.27D8gp120/293F | 0.08 | 0.00 | 0.46 | 4.14 | 3.68 | 6.94 | 7.84 | 6.28 | 9.09 | 5.63 | 1.33 | 5.99 | 8.85 | 7.94 | 8.02 | 8.48 |
| | CH505w030.10D8gp120 | 0.00 | 0.00 | 0.10 | 0.00 | 0.32 | 1.63 | 3.84 | 2.21 | 5.42 | 0.00 | 0.00 | 1.50 | 6.86 | 9.57 | 4.02 | 2.90 |
| | CH505w030.13D8gp120/293F | 0.00 | 0.00 | 0.11 | 0.00 | 0.34 | 1.78 | 4.03 | 2.67 | 6.05 | 0.00 | 0.00 | 1.82 | 7.18 | 10.04 | 4.63 | 3.28 |
| | CH505w030.25D8gp120 | 0.00 | 0.00 | 0.00 | 3.57 | 4.42 | 7.94 | 9.74 | 7.24 | 10.22 | 5.05 | 1.64 | 5.33 | 10.05 | 8.90 | 9.33 | 8.06 |
| | CH505w030.11D8gp120 | 0.00 | 0.00 | 0.00 | 3.40 | 3.32 | 4.98 | 5.83 | 5.86 | 9.15 | 5.91 | 0.10 | 4.61 | 9.11 | 6.52 | 8.63 | 7.00 |
| | CH505w030.18D8gp120 | 0.00 | 0.00 | 0.00 | 2.19 | 3.63 | 7.70 | 9.91 | 6.43 | 9.21 | 6.70 | 0.61 | 5.69 | 10.07 | 9.56 | 8.57 | 8.90 |
| | CH505w030.5D8gp120 | 0.00 | 0.00 | 0.00 | 1.57 | 5.73 | 8.82 | 11.24 | 8.48 | 11.14 | 3.50 | 1.90 | 6.73 | 10.54 | 9.42 | 10.19 | 9.56 |
| | CH505w030.23D8gp120 | 0.00 | 0.00 | 0.00 | 0.45 | 5.57 | 8.43 | 11.22 | 8.37 | 11.52 | 4.26 | 4.28 | 7.91 | 10.40 | 9.09 | 10.52 | 10.28 |
| | CH505w030.9D8gp120 | 0.00 | 0.00 | 0.00 | 0.97 | 1.37 | 5.55 | 6.37 | 3.86 | 8.73 | 3.77 | 0.59 | 4.34 | 7.79 | 6.56 | 7.78 | 7.33 |
| | CH505w030.15D8gp120 | 0.00 | 0.00 | 0.00 | 0.00 | 2.37 | 5.26 | 8.71 | 5.96 | 8.68 | 2.15 | 1.40 | 5.95 | 8.50 | 4.24 | 8.54 | 8.42 |
| | CH505w030.28D8gp120 | 0.00 | 0.00 | 0.00 | 0.00 | 0.31 | 1.51 | 3.57 | 2.38 | 5.01 | 0.00 | 0.00 | 1.84 | 6.72 | 9.62 | 4.16 | 3.18 |
| | CH505w030.17D8gp120 | 0.00 | 0.00 | 0.00 | 0.00 | 0.75 | 3.89 | 3.34 | 3.85 | 7.10 | 1.92 | 0.09 | 2.64 | 7.57 | 0.13 | 6.75 | 5.54 |
| | CH505.w30.12D8gp120 | 0.00 | 0.00 | 0.00 | 0.00 | 0.35 | 0.95 | 3.37 | 2.40 | 3.89 | 0.00 | 0.00 | 1.05 | 7.28 | 9.60 | 3.17 | 2.37 |
| | CH505w030.21D8gp120 | 0.00 | 0.00 | 0.00 | 0.00 | 0.00 | 0.00 | 0.00 | 0.00 | 0.00 | 0.00 | 0.12 | 0.00 | 0.00 | 3.27 | 0.00 | 1.01 |
| | CH505w030.19D8gp120/293F | 0.00 | 0.00 | 0.00 | 0.00 | 0.00 | 0.00 | 0.00 | 0.00 | 0.00 | 0.00 | 0.11 | 0.00 | 0.00 | 1.47 | 0.00 | 0.00 |
| Week 53 | CH505w053.16D8gp120 | 0.00 | 0.00 | 0.00 | 0.00 | 0.00 | 0.34 | 3.70 | 0.47 | 3.51 | 1.62 | 0.12 | 1.99 | 4.63 | 7.19 | 5.76 | 4.75 |
| | CH505w053.25D8gp120 | 0.00 | 0.00 | 0.00 | 0.00 | 0.00 | 0.00 | 0.36 | 0.25 | 3.33 | 1.44 | 0.00 | 0.74 | 3.81 | 0.00 | 6.23 | 4.67 |
| | CH505w053.3D8gp120 | 0.00 | 0.00 | 0.00 | 0.00 | 0.00 | 0.00 | 0.89 | 0.21 | 3.41 | 1.63 | 0.08 | 1.23 | 4.99 | 0.00 | 7.22 | 4.26 |
| | CH505w053.13D8gp120/293F | 0.00 | 0.00 | 0.00 | 0.00 | 0.00 | 0.00 | 0.15 | 0.09 | 2.14 | 2.07 | 0.11 | 2.30 | 2.18 | 0.00 | 6.53 | 5.79 |
| | CH505w053.31D8gp120/293F | 0.00 | 0.00 | 0.00 | 0.00 | 0.00 | 0.00 | 0.00 | 0.00 | 0.00 | 3.25 | 0.11 | 0.35 | 1.11 | 1.41 | 5.23 | 6.36 |
| | CH505.w53.19gp D8gp120 | 0.00 | 0.07 | 0.00 | 0.00 | 0.00 | 0.00 | 0.00 | 0.00 | 0.00 | 1.08 | 0.00 | 0.08 | 0.64 | 0.52 | 3.05 | 3.95 |
| | CH505w053.6D8gp120 | 0.00 | 0.00 | 0.00 | 0.00 | 0.00 | 0.00 | 0.00 | 0.00 | 0.00 | 0.54 | 0.00 | 0.09 | 0.13 | 0.00 | 4.89 | 4.76 |
| | CH505w053.29D8gp120 | 0.00 | 0.00 | 0.00 | 0.00 | 0.00 | 0.00 | 0.00 | 0.00 | 4.84 | 0.00 | 0.00 | 1.04 | 0.00 | 0.00 | 0.25 | 3.44 |

*Figure 60 cont.*

| | Envelope ID | CH235 Lineage | | | | | | | | | | | | | | | |
|---|---|---|---|---|---|---|---|---|---|---|---|---|---|---|---|---|---|
| | | UCA | IA4 | IA3 | IA2 | CH240 | CH236 | CH239 | IA1 | CH235.7 | CH235.10 | CH235.11 | CH235.13 | CH235 | CH241 | CH235.9 | CH235.12 |
| Week 78 | CH0505.w78.env5.D11gp120/293F | 0.00 | 0.00 | 0.00 | 0.00 | 0.00 | 0.00 | 0.00 | 0.00 | 0.07 | 0.09 | 0.23 | 0.46 | 0.00 | 0.00 | 4.69 | 6.11 |
| | CH505w078.33D8gp120/293F | 0.18 | 0.00 | 0.00 | 0.00 | 0.00 | 0.00 | 0.00 | 0.00 | 0.00 | 0.00 | 0.71 | 0.00 | 0.00 | 0.00 | 0.00 | 0.00 |
| | CH505w078.1D8gp120/293F | 0.00 | 0.00 | 0.00 | 0.00 | 0.00 | 0.00 | 0.00 | 0.00 | 0.00 | 0.00 | 0.10 | 0.00 | 0.00 | 0.00 | 0.00 | 0.00 |
| | CH505w078.9D8gp120 | 0.00 | 0.00 | 0.00 | 0.00 | 0.00 | 0.00 | 0.00 | 0.00 | 0.00 | 0.00 | 0.13 | 0.00 | 0.00 | 0.00 | 0.09 | 0.09 |
| | CH505w078.6D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 3.01 |
| | CH505w078.38D8gp120 | 0.11 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w078.15D8gp120/293F | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w078.10D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w078.17D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w078.7D8gp120/293F | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH0505.w78.env4.D11gp120/293i | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w078.25D8gp120 | 0.08 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| Week 100 | CH505w100.C7D8gp120/293F | 0.73 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w100.A13D8gp120 | 0.00 | 0.00 | 0.00 | 0.00 | 0.00 | 0.00 | 0.00 | 0.00 | 0.00 | 0.00 | 0.00 | 0.00 | 0.28 | 0.00 | 0.00 | 0.00 |
| | CH505w100.B6D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.13 |
| | CH505w100.B7D8gp120/293F | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.25 |
| | CH505_w100V115b7.D7gp120/293F | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.13 |
| | CH505w100.A10D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | 505_w100.A4.D8.gp120/293F | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505_w100V115A10.D7gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w100.A12D8gp120 | 0.08 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w100.A3D8gp120/293F | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w100.A6D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w100.B4D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505_w100V115A13.D7gp120/293F | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505_w100V115A6.D11gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505_w100V115B4.D11gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w100.B2D8gp120/293F | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |

*Figure 60 cont.*

| | | CH235 Lineage | | | | | | | | | | | | | | | |
|---|---|---|---|---|---|---|---|---|---|---|---|---|---|---|---|---|---|
| | Envelope ID | UCA | IA4 | IA3 | IA2 | CH240 | CH236 | CH239 | IA1 | CH235.7 | CH235.10 | CH235.11 | CH235.13 | CH235 | CH241 | CH235.9 | CH235.12 |
| Week 136 | CH505w136.B18D8gp120 | 0.00 | 0.00 | 0.00 | 0.00 | 0.25 | 3.51 | 0.74 | 2.36 | 3.53 | 5.54 | 0.11 | 1.76 | 7.53 | 0.89 | 5.76 | 8.31 |
| | CH505w136.B2D8gp120/293F | 0.00 | 0.00 | 0.00 | 0.00 | 0.00 | 0.00 | 0.00 | 0.00 | 0.07 | 0.64 | 0.00 | 0.00 | 0.74 | 0.00 | 2.38 | 2.58 |
| | CH505_w137V201B12.D11gp120 | 0.00 | 0.00 | 0.00 | 0.00 | 0.00 | 0.00 | 0.00 | 0.00 | 0.00 | 0.00 | 0.28 | 0.00 | 0.00 | 0.00 | 0.00 | 0.00 |
| | CH505w136.B3D8gp120/293F | 0.00 | 0.00 | 0.00 | 0.00 | 0.00 | 0.00 | 0.00 | 0.00 | 0.00 | 0.00 | 0.72 | 0.00 | 0.00 | 0.00 | 0.00 | 0.00 |
| | CH505w136.B5D8gp120 | 0.00 | 0.00 | 0.00 | 0.00 | 0.00 | 0.00 | 0.00 | 0.00 | 0.00 | 0.00 | 0.52 | 0.00 | 0.00 | 0.00 | 0.00 | 0.00 |
| | CH505w136.B8D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.34 | 0.00 |
| | CH505w136.B36D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.11 |
| | CH505w136.B20D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.07 |
| | CH505_w137V209C12.D11gp120 | 0.08 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w136.B27D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w136.B29D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w136.B4D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w136.B12D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w136.B10D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| Week 160 | CH505w160.T4D8gp120/293F | 0.00 | 0.00 | 0.00 | 0.00 | 0.00 | 0.10 | 0.00 | 0.10 | 0.13 | 0.32 | 0.00 | 0.46 | 0.98 | 0.34 | 0.82 | 3.32 |
| | CH505w160.C2D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.31 |
| | CH505w160.C4D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.16 |
| | CH505w160.C12D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w160.C14D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.09 |
| | CH505w160.A1D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w160.C11D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w160.D1D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w160.D5D8gp120/293F | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |
| | CH505w160.T2D8gp120 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 | 0.00 |

*Figure 60 cont.*

| | | CH235 Lineage | | | | | | | | | | | | | | | |
|---|---|---|---|---|---|---|---|---|---|---|---|---|---|---|---|---|---|
| | Envelope ID | UCA | IA4 | IA3 | IA2 | CH240 | CH236 | CH239 | IA1 | CH235.7 | CH235.10 | CH235.11 | CH235.13 | CH235 | CH241 | CH235.9 | CH235.12 |
| | CH505.M5D8gp120293F | 0.24 | 1.36 | 7.01 | 6.95 | 7.39 | 7.27 | 12.94 | 9.18 | 10.58 | 2.62 | 1.26 | 6.53 | 11.36 | 14.51 | 9.26 | 8.20 |
| | CH505.M10D8gp120 | 0.00 | 0.12 | 0.08 | 0.43 | 3.13 | 6.07 | 11.17 | 7.08 | 10.55 | 1.06 | 1.06 | 6.38 | 10.63 | 14.40 | 10.17 | 7.63 |
| | CH505.M6D8gp120/293F | 0.00 | 0.00 | 2.96 | 1.22 | 3.52 | 6.31 | 8.97 | 6.10 | 9.21 | 5.67 | 0.09 | 6.07 | 9.46 | 13.17 | 8.11 | 8.21 |
| CH505 | CH505.M11D8gp120/293F | 0.00 | 0.00 | 0.00 | 0.00 | 0.51 | 1.43 | 1.35 | 2.85 | 6.75 | 5.05 | 0.11 | 5.35 | 7.59 | 9.68 | 8.26 | 7.71 |
| TF | CH505.M19D8gp120 | 0.00 | 0.00 | 0.11 | 0.00 | 0.65 | 1.54 | 4.34 | 2.78 | 6.61 | 0.00 | 0.09 | 2.89 | 7.13 | 10.44 | 5.95 | 4.61 |
| Mutants | CH505.M8D8gp120 | 0.00 | 0.00 | 0.00 | 0.00 | 0.00 | 0.00 | 0.00 | 0.00 | 0.00 | 0.00 | 0.29 | 0.00 | 0.00 | 2.18 | 4.36 | 1.14 |
| Loop D | CH505.M20D8gp120/293F | 0.00 | 0.00 | 0.00 | 0.00 | 0.00 | 0.00 | 0.00 | 0.00 | 0.00 | 0.00 | 0.28 | 0.00 | 0.00 | 2.15 | 1.04 | 0.00 |
| | CH505.M21D8gp120/293F | 0.00 | 0.00 | 0.00 | 0.00 | 0.00 | 0.00 | 0.00 | 0.00 | 0.00 | 0.00 | 0.10 | 0.00 | 0.00 | 4.82 | 1.13 | 0.19 |
| | CH505.M9D8gp120/293F | 0.00 | 0.00 | 0.00 | 0.00 | 0.00 | 0.00 | 0.00 | 0.00 | 0.00 | 0.07 | 0.23 | 0.00 | 0.00 | 0.00 | 1.31 | 0.38 |
| | CH505.M7D8gp120/293F | 0.00 | 0.00 | 0.00 | 0.00 | 0.00 | 0.00 | 0.00 | 0.00 | 0.00 | 0.09 | 0.00 | 0.00 | 0.00 | 0.00 | 0.80 | 0.69 |

*Figure 60 cont.*

| | Envelope ID | UCA | IA8 | IA7 | IA6 | IA4 | CH187 | CH188 | CH186 | CH200 | 1AH92U | IA3 | IA2 | IA1 | CH103 | CH104 |
|---|---|---|---|---|---|---|---|---|---|---|---|---|---|---|---|---|
| | | CH103 Lineage | | | | | | | | | | | | | | |
| | CH0505_CON D7gp120/293i | 4.30 | 7.21 | 10.96 | 10.86 | 11.33 | 11.79 | 11.60 | 13.00 | 9.42 | 11.19 | 11.27 | 11.97 | 11.26 | 12.45 | 10.15 |
| Week 4 | CH505w004.10D8gp120/293F | 0.00 | 0.45 | 2.26 | 2.89 | 2.84 | 7.92 | 7.63 | 11.59 | 8.50 | 6.03 | 6.17 | 6.85 | 6.17 | 9.21 | 8.13 |
| | CH505.w4.26D8gp120 /293F | 3.20 | 5.48 | 9.05 | 9.04 | 9.53 | 11.86 | 11.88 | 13.47 | 9.51 | 10.20 | 10.05 | 10.63 | 10.28 | 12.35 | 11.08 |
| | 505.s.03.D8.gp120/293F | 3.53 | 5.45 | 9.21 | 9.07 | 10.14 | 12.58 | 12.35 | 14.05 | 10.14 | 9.42 | 9.97 | 10.83 | 10.38 | 12.63 | 10.41 |
| Week 14 | CH505w014.8D8gp120 | 0.00 | 0.95 | 0.62 | 2.43 | 2.62 | 8.89 | 9.28 | 12.29 | 2.46 | 7.26 | 1.73 | 3.60 | 3.38 | 11.22 | 3.86 |
| | CH505w014.2D8gp120/293F | 0.83 | 3.17 | 7.18 | 6.90 | 8.47 | 10.69 | 10.53 | 12.43 | 9.01 | 8.98 | 9.31 | 9.69 | 9.14 | 10.88 | 9.49 |
| | CH505w014.32D8gp120/293F | 1.61 | 4.25 | 7.88 | 7.82 | 8.46 | 11.99 | 11.89 | 13.50 | 10.00 | 9.14 | 9.58 | 10.21 | 9.53 | 11.93 | 10.91 |
| | CH505w014.3D8gp120 | 1.01 | 4.38 | 7.65 | 7.62 | 9.20 | 11.86 | 11.76 | 13.43 | 9.97 | 8.93 | 9.82 | 10.57 | 9.62 | 11.89 | 10.63 |
| | CH505.08.D11gp120/293F | 2.25 | 4.52 | 7.84 | 8.02 | 8.51 | 9.47 | 9.14 | 11.49 | 7.30 | 8.24 | 8.56 | 9.38 | 8.70 | 10.26 | 8.25 |
| | CH505w014.10D8gp120 | 0.31 | 2.22 | 5.14 | 6.33 | 7.07 | 12.04 | 12.09 | 13.78 | 9.44 | 9.44 | 9.32 | 9.92 | 9.38 | 11.92 | 10.74 |
| | CH505w014.21D8gp120/293F | 0.39 | 2.82 | 6.25 | 7.78 | 8.05 | 12.48 | 12.40 | 14.16 | 10.14 | 9.83 | 9.28 | 10.21 | 9.68 | 13.06 | 11.36 |
| Week 20 | CH505w020.15D8gp120 | 1.57 | 4.21 | 8.19 | 7.78 | 9.06 | 11.85 | 11.52 | 13.26 | 10.07 | 7.20 | 9.49 | 10.45 | 9.89 | 11.76 | 10.54 |
| | CH505w020.13D8gp120 | 0.83 | 2.41 | 6.37 | 6.05 | 7.28 | 9.25 | 8.96 | 11.14 | 8.27 | 8.22 | 8.45 | 9.02 | 8.64 | 10.34 | 8.31 |
| | CH505w020.22D8gp120/293F | 1.24 | 3.97 | 8.28 | 8.37 | 8.80 | 11.00 | 11.21 | 12.46 | 10.18 | 9.42 | 10.21 | 10.57 | 10.14 | 11.49 | 10.70 |
| | CH505w020.14D8gp120 | 0.33 | 3.40 | 7.23 | 7.94 | 8.64 | 11.17 | 10.85 | 12.83 | 8.68 | 10.41 | 10.50 | 10.98 | 10.27 | 12.55 | 10.39 |
| | CH505w020.8D8gp120/293F | 0.44 | 2.56 | 5.90 | 6.69 | 7.37 | 11.22 | 11.36 | 13.00 | 9.04 | 10.08 | 9.86 | 10.47 | 9.88 | 12.38 | 10.52 |
| | CH505w020.3D8gp120 | 0.77 | 2.57 | 5.88 | 5.98 | 7.05 | 11.21 | 11.44 | 13.36 | 7.12 | 10.18 | 8.37 | 9.28 | 8.86 | 12.43 | 9.80 |
| | CH505w020.30D8gp120 | 0.79 | 4.18 | 7.31 | 7.89 | 8.45 | 11.21 | 11.44 | 12.68 | 8.24 | 10.31 | 9.66 | 10.46 | 9.84 | 11.71 | 10.08 |
| | CH505w020.23D8gp120 | 0.94 | 3.57 | 7.17 | 7.89 | 8.58 | 12.39 | 12.43 | 14.02 | 9.59 | 9.89 | 10.14 | 10.65 | 9.85 | 12.83 | 11.56 |
| | CH505w020.11D8gp120 | 0.00 | 0.90 | 0.10 | 0.78 | 0.75 | 5.81 | 4.97 | 10.29 | 2.09 | 5.49 | 0.97 | 2.58 | 1.83 | 9.59 | 2.18 |
| | CH505w020.9D8gp120 | 0.38 | 2.84 | 4.89 | 6.79 | 7.41 | 11.01 | 10.90 | 12.66 | 6.89 | 9.74 | 8.68 | 9.65 | 8.99 | 11.85 | 8.86 |
| | CH505w020.4D8gp120/293F | 0.93 | 3.63 | 8.18 | 8.66 | 9.41 | 12.13 | 12.26 | 13.64 | 10.34 | 10.78 | 11.18 | 11.61 | 11.34 | 12.50 | 11.61 |
| | CH505w020.7D8gp120 | 0.57 | 2.74 | 7.63 | 8.09 | 8.75 | 11.51 | 11.60 | 12.94 | 9.76 | 10.56 | 10.83 | 11.27 | 10.85 | 12.46 | 11.11 |
| | CH505w020.26D8gp120 | 0.00 | 0.72 | 2.73 | 3.97 | 5.10 | 10.40 | 10.34 | 12.41 | 7.61 | 8.21 | 8.18 | 8.99 | 8.92 | 11.27 | 8.67 |

*Figure 60 cont.*

| | | CH103 Lineage | | | | | | |
|---|---|---|---|---|---|---|---|---|
| | Envelope ID | CH105 | CH106 | CH243 | CH244 | CH245 | CH247 | CH248 |
| | CH0505_CON D7gp120/293i | 10.62 | 11.88 | 12.52 | 12.35 | 13.23 | 12.87 | 12.91 |
| Week 4 | CH505w004.10D8gp120/293F | 8.33 | 8.06 | 10.08 | 9.96 | 10.25 | 11.11 | 10.76 |
| Week 4 | CH505.w4.26D8gp120 /293F | 10.45 | 11.05 | 13.00 | 12.79 | 13.38 | 12.82 | 13.05 |
| Week 4 | 505.s.03.D8.gp120/293F | 11.18 | 11.28 | 13.40 | 12.96 | 13.86 | 13.08 | 13.34 |
| Week 14 | CH505w014.8D8gp120 | 6.01 | 7.94 | 10.86 | 10.07 | 10.64 | 12.59 | 11.68 |
| Week 14 | CH505w014.2D8gp120/293F | 9.62 | 9.62 | 11.86 | 11.41 | 11.97 | 12.48 | 12.04 |
| Week 14 | CH505w014.32D8gp120/293F | 10.70 | 10.54 | 12.94 | 12.92 | 13.42 | 12.65 | 13.05 |
| Week 14 | CH505w014.3D8gp120 | 10.81 | 10.64 | 12.81 | 12.78 | 12.72 | 13.00 | 13.32 |
| Week 14 | CH505.08.D11gp120/293F | 8.30 | 9.20 | 10.80 | 10.19 | 10.66 | 11.06 | 10.92 |
| Week 14 | CH505w014.10D8gp120 | 10.81 | 10.37 | 13.24 | 12.98 | 12.86 | 13.12 | 12.85 |
| Week 14 | CH505w014.21D8gp120/293F | 11.40 | 11.09 | 13.48 | 13.40 | 13.65 | 13.41 | 13.57 |
| Week 20 | CH505w020.15D8gp120 | 10.84 | 10.46 | 12.82 | 12.42 | 12.80 | 13.27 | 12.55 |
| Week 20 | CH505w020.13D8gp120 | 8.22 | 9.44 | 10.36 | 9.82 | 9.71 | 10.68 | 10.78 |
| Week 20 | CH505w020.22D8gp120/293F | 10.45 | 10.68 | 12.46 | 12.48 | 12.68 | 13.06 | 12.68 |
| Week 20 | CH505w020.14D8gp120 | 10.42 | 11.23 | 12.61 | 12.32 | 12.11 | 12.08 | 12.48 |
| Week 20 | CH505w020.8D8gp120/293F | 10.55 | 10.96 | 12.97 | 12.73 | 12.68 | 12.60 | 12.89 |
| Week 20 | CH505w020.3D8gp120 | 10.11 | 10.25 | 12.73 | 12.78 | 12.68 | 12.69 | 12.27 |
| Week 20 | CH505w020.30D8gp120 | 10.26 | 10.80 | 12.67 | 12.53 | 12.28 | 12.38 | 12.71 |
| Week 20 | CH505w020.23D8gp120 | 11.20 | 11.30 | 13.53 | 13.17 | 12.97 | 13.24 | 13.24 |
| Week 20 | CH505w020.11D8gp120 | 3.61 | 5.37 | 7.38 | 7.08 | 8.43 | 10.44 | 9.22 |
| Week 20 | CH505w020.9D8gp120 | 9.31 | 10.02 | 12.22 | 11.92 | 11.43 | 12.54 | 12.30 |
| Week 20 | CH505w020.4D8gp120/293F | 11.14 | 11.49 | 13.28 | 13.39 | 13.66 | 13.48 | 13.30 |
| Week 20 | CH505w020.7D8gp120 | 10.62 | 11.29 | 12.76 | 12.41 | 12.40 | 12.35 | 12.88 |
| Week 20 | CH505w020.26D8gp120 | 9.01 | 9.56 | 11.61 | 11.45 | 11.37 | 12.22 | 12.01 |

*Figure 60 cont.*

| | | CH103 Lineage | | | | | | | | | | | | | | |
|---|---|---|---|---|---|---|---|---|---|---|---|---|---|---|---|---|
| | Envelope ID | UCA | IA8 | IA7 | IA6 | IA4 | CH187 | CH188 | CH186 | CH200 | 1AH92U | IA3 | IA2 | IA1 | CH103 | CH104 |
| Week 30 | CH505w030.6D8gp120/293F | 0.00 | 0.00 | 0.00 | 0.00 | 0.00 | 1.71 | 1.85 | 10.03 | 6.28 | 4.58 | 3.16 | 5.38 | 4.51 | 8.05 | 6.13 |
| | CH505w030.36D8gp120 | 0.00 | 0.00 | 0.00 | 0.00 | 0.00 | 4.72 | 4.80 | 12.14 | 9.03 | 6.39 | 5.80 | 7.27 | 6.69 | 9.08 | 7.83 |
| | CH505.w30.12D8gp140 | 0.00 | 0.00 | 0.00 | 0.21 | 0.29 | 7.20 | 7.32 | 7.62 | 5.72 | 6.22 | 3.88 | 7.28 | 7.05 | 10.66 | 8.20 |
| | CH505w030.20D8gp120/293F | 0.00 | 0.00 | 0.00 | 0.00 | 0.00 | 1.16 | 1.19 | 8.59 | 2.84 | 4.89 | 4.62 | 6.26 | 5.65 | 9.48 | 7.49 |
| | CH505w030.27D8gp120/293F | 0.00 | 0.00 | 0.00 | 0.00 | 0.00 | 7.13 | 7.07 | 12.75 | 8.96 | 6.52 | 5.98 | 7.90 | 7.31 | 9.12 | 8.17 |
| | CH505w030.10D8gp120 | 0.18 | 1.26 | 3.24 | 5.06 | 5.77 | 12.02 | 12.32 | 12.48 | 7.56 | 9.03 | 7.79 | 10.98 | 10.10 | 12.50 | 10.34 |
| | CH505w030.13D8gp120/293F | 0.25 | 1.96 | 4.72 | 6.48 | 7.39 | 13.37 | 13.60 | 13.30 | 9.19 | 10.03 | 8.65 | 11.44 | 10.47 | 12.89 | 11.29 |
| | CH505w030.25D8gp120 | 0.00 | 0.00 | 0.36 | 0.49 | 0.36 | 11.46 | 11.68 | 14.73 | 9.99 | 8.75 | 8.78 | 9.93 | 9.08 | 12.50 | 10.33 |
| | CH505w030.11D8gp120 | 0.00 | 0.00 | 0.73 | 0.48 | 0.49 | 10.21 | 10.14 | 13.59 | 10.92 | 7.02 | 6.82 | 9.12 | 8.40 | 10.92 | 9.48 |
| | CH505w030.18D8gp120 | 0.00 | 0.00 | 0.00 | 0.00 | 0.00 | 4.27 | 4.50 | 10.44 | 8.76 | 8.59 | 8.13 | 9.42 | 9.92 | 13.05 | 10.91 |
| | CH505w030.5D8gp120 | 0.00 | 0.00 | 0.00 | 0.00 | 0.00 | 10.12 | 10.26 | 14.05 | 8.91 | 7.40 | 6.70 | 8.09 | 7.75 | 11.43 | 9.44 |
| | CH505w030.23D8gp120 | 0.00 | 0.00 | 0.00 | 0.00 | 0.00 | 10.43 | 10.47 | 13.87 | 9.53 | 7.75 | 7.83 | 8.86 | 8.42 | 11.08 | 9.58 |
| | CH505w030.9D8gp120 | 0.00 | 0.00 | 0.00 | 0.00 | 0.00 | 8.32 | 8.51 | 13.64 | 9.74 | 7.41 | 7.11 | 8.59 | 7.79 | 10.23 | 8.94 |
| | CH505w030.15D8gp120 | 0.00 | 0.00 | 0.00 | 0.00 | 0.00 | 3.92 | 3.78 | 10.84 | 8.12 | 6.91 | 7.84 | 8.37 | 8.04 | 10.06 | 9.67 |
| | CH505w030.28D8gp120 | 0.00 | 1.59 | 3.52 | 6.34 | 6.47 | 12.33 | 12.50 | 12.61 | 7.51 | 9.64 | 7.73 | 11.07 | 10.07 | 12.78 | 10.68 |
| | CH505w030.17D8gp120 | 0.00 | 0.00 | 0.00 | 0.00 | 0.00 | 6.69 | 7.21 | 13.59 | 6.10 | 6.57 | 4.11 | 7.00 | 5.79 | 9.92 | 6.99 |
| | CH505.w30.12D8gp120 | 0.00 | 0.36 | 0.98 | 1.22 | 1.91 | 11.70 | 11.64 | 12.02 | 7.29 | 9.35 | 7.58 | 11.64 | 10.62 | 13.25 | 11.62 |
| | CH505w030.21D8gp120 | 0.00 | 0.00 | 0.00 | 0.00 | 0.00 | 0.00 | 0.00 | 0.00 | 3.17 | 9.50 | 11.00 | 11.46 | 11.78 | 12.25 | 11.30 |
| | CH505w030.19D8gp120/293F | 0.00 | 0.00 | 0.00 | 0.00 | 0.00 | 0.00 | 0.00 | 0.00 | 0.26 | 9.46 | 6.38 | 8.24 | 8.23 | 12.85 | 8.88 |
| Week 53 | CH505w053.16D8gp120 | 0.00 | 0.00 | 0.00 | 0.00 | 0.22 | 2.00 | 2.10 | 7.55 | 5.12 | 8.03 | 7.76 | 9.26 | 8.79 | 11.62 | 9.94 |
| | CH505w053.25D8gp120 | 0.00 | 0.00 | 0.00 | 0.00 | 0.00 | 0.85 | 1.17 | 8.55 | 7.97 | 8.50 | 8.67 | 10.23 | 10.00 | 11.64 | 10.61 |
| | CH505w053.3D8gp120 | 0.00 | 0.00 | 0.00 | 0.00 | 0.00 | 1.04 | 1.49 | 9.17 | 6.13 | 7.92 | 8.31 | 9.45 | 9.21 | 11.21 | 10.41 |
| | CH505w053.13D8gp120/293F | 0.00 | 0.00 | 0.00 | 0.00 | 0.00 | 0.79 | 1.05 | 8.34 | 7.14 | 8.28 | 9.20 | 10.47 | 9.93 | 11.22 | 9.99 |
| | CH505w053.31D8gp120/293F | 0.00 | 0.00 | 0.00 | 0.00 | 0.00 | 0.00 | 0.00 | 1.13 | 5.80 | 11.26 | 13.01 | 13.34 | 13.36 | 13.63 | 13.73 |
| | CH505.w53.19gp D8gp120 | 0.00 | 0.00 | 0.00 | 0.00 | 0.00 | 0.00 | 0.00 | 0.42 | 3.36 | 11.78 | 13.22 | 12.61 | 13.56 | 13.49 | 13.82 |
| | CH505w053.6D8gp120 | 0.00 | 0.00 | 0.00 | 0.00 | 0.00 | 0.00 | 0.00 | 0.00 | 1.27 | 9.90 | 11.17 | 11.95 | 11.37 | 12.66 | 12.05 |
| | CH505w053.29D8gp120 | 0.00 | 0.00 | 0.00 | 0.00 | 0.00 | 0.46 | 0.82 | 7.64 | 2.42 | 7.56 | 7.72 | 9.16 | 8.79 | 10.17 | 9.80 |

*Figure 60 cont.*

| | | CH103 Lineage | | | | | | |
|---|---|---|---|---|---|---|---|---|
| | Envelope ID | CH105 | CH106 | CH243 | CH244 | CH245 | CH247 | CH248 |
| Week 30 | CH505w030.6D8gp120/293F | 6.47 | 6.56 | 8.07 | 7.95 | 9.25 | 10.28 | 8.88 |
| | CH505w030.36D8gp120 | 7.46 | 8.47 | 10.01 | 9.61 | 12.14 | 11.98 | 11.14 |
| | CH505.w30.12D8gp140 | 7.63 | 8.13 | 10.29 | 9.96 | 9.48 | 11.85 | 9.71 |
| | CH505w030.20D8gp120/293F | 7.10 | 7.25 | 9.03 | 10.06 | 9.90 | 11.61 | 9.97 |
| | CH505w030.27D8gp120/293F | 7.88 | 8.17 | 10.10 | 9.49 | 11.87 | 11.61 | 10.96 |
| | CH505w030.10D8gp120 | 9.26 | 11.14 | 12.62 | 12.40 | 12.77 | 13.78 | 12.69 |
| | CH505w030.13D8gp120/293F | 10.46 | 11.88 | 13.79 | 13.74 | 13.97 | 14.50 | 13.48 |
| | CH505w030.25D8gp120 | 9.96 | 10.19 | 12.12 | 11.82 | 13.44 | 12.58 | 12.82 |
| | CH505w030.11D8gp120 | 8.97 | 9.41 | 11.56 | 11.41 | 13.73 | 12.68 | 11.85 |
| | CH505w030.18D8gp120 | 11.14 | 10.54 | 13.24 | 13.55 | 14.17 | 13.07 | 12.96 |
| | CH505w030.5D8gp120 | 8.98 | 9.41 | 11.45 | 11.09 | 13.15 | 12.93 | 12.40 |
| | CH505w030.23D8gp120 | 9.18 | 9.98 | 11.69 | 11.44 | 12.97 | 12.36 | 12.26 |
| | CH505w030.9D8gp120 | 8.67 | 9.61 | 11.06 | 8.65 | 13.08 | 12.77 | 11.97 |
| | CH505w030.15D8gp120 | 9.27 | 9.33 | 11.17 | 10.60 | 12.57 | 11.18 | 11.98 |
| | CH505w030.28D8gp120 | 9.13 | 11.71 | 12.65 | 12.46 | 12.42 | 13.77 | 12.74 |
| | CH505w030.17D8gp120 | 6.73 | 8.20 | 9.93 | 9.56 | 12.83 | 13.03 | 11.50 |
| | CH505.w30.12D8gp120 | 10.68 | 11.76 | 13.89 | 13.68 | 13.80 | 13.89 | 13.22 |
| | CH505w030.21D8gp120 | 10.55 | 10.91 | 12.86 | 12.95 | 12.50 | 11.55 | 13.33 |
| | CH505w030.19D8gp120/293F | 9.46 | 7.39 | 12.61 | 13.20 | 11.64 | 12.72 | 13.55 |
| Week 53 | CH505w053.16D8gp120 | 9.00 | 9.78 | 11.64 | 11.51 | 13.45 | 12.38 | 12.94 |
| | CH505w053.25D8gp120 | 10.00 | 10.88 | 11.76 | 11.82 | 13.14 | 12.17 | 12.61 |
| | CH505w053.3D8gp120 | 9.41 | 10.09 | 11.74 | 11.52 | 13.30 | 11.93 | 12.78 |
| | CH505w053.13D8gp120/293F | 9.37 | 10.17 | 11.45 | 11.80 | 12.34 | 11.53 | 12.19 |
| | CH505w053.31D8gp120/293F | 13.52 | 13.35 | 14.44 | 15.25 | 15.04 | 14.15 | 15.19 |
| | CH505.w53.19gp D8gp120 | 13.75 | 13.24 | 14.43 | 15.75 | 15.37 | 14.20 | 14.82 |
| | CH505w053.6D8gp120 | 11.74 | 10.93 | 13.06 | 14.13 | 13.65 | 13.02 | 13.46 |
| | CH505w053.29D8gp120 | 8.51 | 9.70 | 10.73 | 10.38 | 11.51 | 11.14 | 11.51 |

*Figure 60 cont.*

| | | CH103 Lineage | | | | | | | | | | | | | | |
|---|---|---|---|---|---|---|---|---|---|---|---|---|---|---|---|---|
| | Envelope ID | UCA | IA8 | IA7 | IA6 | IA4 | CH187 | CH188 | CH186 | CH200 | 1AH92U | IA3 | IA2 | IA1 | CH103 | CH104 |
| Week 78 | CH0505.w78.env5.D11gp120/293F | 0.00 | 0.00 | 0.00 | 0.00 | 0.00 | 0.00 | 0.00 | 4.95 | 2.91 | 4.33 | 3.39 | 6.57 | 5.64 | 10.24 | 7.67 |
| | CH505w078.33D8gp120/293F | 0.00 | 0.00 | 0.00 | 0.00 | 0.00 | 0.00 | 0.00 | 0.00 | 0.56 | 8.07 | 7.10 | 8.97 | 8.24 | 11.08 | 8.97 |
| | CH505w078.1D8gp120/293F | 0.00 | 0.00 | 0.00 | 0.00 | 0.00 | 0.00 | 0.00 | 0.00 | 0.00 | 7.70 | 6.06 | 7.73 | 7.53 | 11.03 | 8.34 |
| | CH505w078.9D8gp120 | 0.00 | 0.00 | 0.00 | 0.00 | 0.00 | 0.00 | 0.00 | 1.86 | 2.27 | 6.11 | 5.78 | 7.18 | 6.29 | 8.93 | 6.85 |
| | CH505w078.6D8gp120 | 0.00 | 0.00 | 0.00 | 0.00 | 0.00 | 0.00 | 0.00 | 0.00 | 0.13 | 3.43 | 1.04 | 4.57 | 3.00 | 9.94 | 4.50 |
| | CH505w078.38D8gp120 | 0.00 | 0.00 | 0.00 | 0.00 | 0.00 | 1.07 | 1.22 | 6.19 | 0.57 | 3.76 | 1.94 | 4.70 | 4.41 | 7.69 | 4.22 |
| | CH505w078.15D8gp120/293F | 0.00 | 0.00 | 0.68 | 0.99 | 1.32 | 5.54 | 5.65 | 9.55 | 1.86 | 9.25 | 10.66 | 11.49 | 10.91 | 10.70 | 10.83 |
| | CH505w078.10D8gp120 | 0.00 | 0.00 | 0.00 | 0.00 | 0.00 | 5.29 | 5.80 | 12.35 | 1.45 | 6.53 | 4.40 | 6.56 | 6.63 | 11.13 | 8.09 |
| | CH505w078.17D8gp120 | 0.00 | 0.00 | 0.00 | 0.00 | 0.00 | 0.00 | 0.00 | 0.00 | 0.09 | 8.31 | 8.95 | 9.91 | 8.99 | 11.32 | 9.98 |
| | CH505w078.7D8gp120/293F | 0.00 | 0.00 | 0.00 | 0.00 | 0.00 | 0.00 | 0.00 | 0.00 | 0.00 | 8.36 | 8.26 | 9.19 | 8.94 | 11.38 | 9.49 |
| | CH0505.w78.env4.D11gp120/293i | 0.00 | 0.00 | 0.00 | 0.00 | 0.00 | 0.00 | 0.00 | 0.00 | 0.00 | 8.98 | 9.29 | 10.21 | 9.80 | 11.72 | 10.08 |
| | CH505w078.25D8gp120 | 0.00 | 0.00 | 0.00 | 0.00 | 0.00 | 0.00 | 0.00 | 0.00 | 0.16 | 3.59 | 1.37 | 3.19 | 2.40 | 8.75 | 3.47 |
| Week 100 | CH505w100.C7D8gp120/293F | 0.00 | 0.00 | 0.00 | 0.00 | 0.00 | 0.00 | 0.00 | 0.00 | 0.00 | 0.10 | 6.85 | 9.14 | 8.86 | 4.78 | 9.20 |
| | CH505w100.A13D8gp120 | 0.00 | 0.00 | 0.00 | 0.00 | 0.00 | 0.00 | 0.00 | 0.00 | 0.10 | 10.66 | 10.95 | 12.47 | 12.56 | 12.89 | 12.94 |
| | CH505w100.B6D8gp120 | 0.00 | 0.00 | 0.00 | 0.00 | 0.00 | 0.00 | 0.00 | 0.00 | 0.00 | 1.84 | 9.81 | 12.11 | 12.21 | 7.07 | 11.02 |
| | CH505w100.B7D8gp120/293F | 0.00 | 0.00 | 0.00 | 0.00 | 0.00 | 0.00 | 0.00 | 0.00 | 0.00 | 2.43 | 10.56 | 12.37 | 11.90 | 7.77 | 11.62 |
| | CH505_w100V115b7.D7gp120/293F | 0.00 | 0.00 | 0.00 | 0.00 | 0.00 | 0.00 | 0.00 | 0.00 | 0.00 | 2.62 | 11.34 | 12.92 | 12.87 | 8.66 | 13.49 |
| | CH505w100.A10D8gp120 | 0.00 | 0.00 | 0.00 | 0.00 | 0.00 | 7.23 | 7.93 | 12.41 | 3.02 | 8.52 | 8.67 | 10.45 | 9.89 | 11.73 | 10.08 |
| | 505_w100.A4.D8.gp120/293F | 0.00 | 0.00 | 0.00 | 0.00 | 0.00 | 5.35 | 5.76 | 11.31 | 2.85 | 7.32 | 7.39 | 8.84 | 8.72 | 11.29 | 9.55 |
| | CH505_w100V115A10.D7gp120 | 0.00 | 0.00 | 0.00 | 0.00 | 0.00 | 8.00 | 8.66 | 13.44 | 4.09 | 8.31 | 7.16 | 9.58 | 8.82 | 12.54 | 10.20 |
| | CH505w100.A12D8gp120 | 0.00 | 0.00 | 0.00 | 0.00 | 0.00 | 0.00 | 0.00 | 0.00 | 0.00 | 0.12 | 7.40 | 9.42 | 8.56 | 4.70 | 10.41 |
| | CH505w100.A3D8gp120/293F | 0.00 | 0.00 | 0.00 | 0.00 | 0.00 | 0.00 | 0.00 | 0.00 | 0.00 | 8.21 | 6.37 | 9.34 | 8.54 | 11.40 | 9.97 |
| | CH505w100.A6D8gp120 | 0.00 | 0.00 | 0.00 | 0.00 | 0.00 | 0.00 | 0.00 | 0.00 | 0.00 | 9.78 | 9.48 | 11.38 | 11.00 | 12.14 | 11.60 |
| | CH505w100.B4D8gp120 | 0.00 | 0.00 | 0.00 | 0.00 | 0.00 | 0.00 | 0.00 | 0.00 | 0.00 | 7.83 | 12.89 | 13.42 | 13.74 | 9.73 | 13.07 |
| | CH505_w100V115A13.D7gp120/293F | 0.00 | 0.00 | 0.00 | 0.00 | 0.00 | 0.00 | 0.00 | 0.00 | 0.00 | 0.20 | 8.26 | 9.84 | 8.86 | 6.13 | 10.83 |
| | CH505_w100V115A6.D11gp120 | 0.00 | 0.00 | 0.00 | 0.00 | 0.00 | 0.00 | 0.00 | 0.00 | 0.00 | 10.38 | 11.20 | 12.60 | 12.20 | 12.62 | 13.47 |
| | CH505_w100V115B4.D11gp120 | 0.00 | 0.00 | 0.00 | 0.00 | 0.00 | 0.00 | 0.00 | 0.00 | 0.00 | 8.18 | 12.68 | 13.42 | 13.50 | 12.52 | 14.02 |
| | CH505w100.B2D8gp120/293F | 0.00 | 0.00 | 0.00 | 0.00 | 0.00 | 0.00 | 0.00 | 0.00 | 0.00 | 0.10 | 4.11 | 7.49 | 7.33 | 3.22 | 6.13 |

*Figure 60 cont.*

| | Envelope ID | CH103 Lineage | | | | | | |
|---|---|---|---|---|---|---|---|---|
| | | CH105 | CH106 | CH243 | CH244 | CH245 | CH247 | CH248 |
| Week 78 | CH0505.w78.env5.D11gp120/293F | 6.61 | 7.89 | 10.04 | 11.29 | 11.15 | 12.47 | 10.90 |
| | CH505w078.33D8gp120/293F | 8.86 | 9.48 | 10.77 | 11.46 | 12.22 | 11.66 | 12.08 |
| | CH505w078.1D8gp120/293F | 7.48 | 7.29 | 10.55 | 11.24 | 8.36 | 11.02 | 10.38 |
| | CH505w078.9D8gp120 | 6.59 | 8.34 | 8.96 | 9.22 | 11.09 | 10.34 | 10.60 |
| | CH505w078.6D8gp120 | 3.80 | 6.72 | 8.99 | 9.77 | 10.16 | 10.78 | 9.68 |
| | CH505w078.38D8gp120 | 3.98 | 5.25 | 6.04 | 6.32 | 7.60 | 9.77 | 7.02 |
| | CH505w078.15D8gp120/293F | 10.08 | 10.95 | 12.13 | 11.86 | 11.70 | 11.62 | 11.57 |
| | CH505w078.10D8gp120 | 7.61 | 7.84 | 10.95 | 10.91 | 12.38 | 12.76 | 11.44 |
| | CH505w078.17D8gp120 | 9.53 | 8.72 | 11.65 | 12.18 | 11.57 | 11.40 | 11.67 |
| | CH505w078.7D8gp120/293F | 9.41 | 8.71 | 11.51 | 12.05 | 10.78 | 11.12 | 11.07 |
| | CH0505.w78.env4.D11gp120/293i | 9.53 | 9.25 | 12.00 | 12.40 | 11.73 | 11.11 | 11.99 |
| | CH505w078.25D8gp120 | 3.33 | 4.64 | 6.47 | 6.68 | 10.41 | 10.10 | 9.71 |
| Week 100 | CH505w100.C7D8gp120/293F | 8.96 | 9.30 | 11.30 | 11.78 | 12.06 | 7.94 | 10.76 |
| | CH505w100.A13D8gp120 | 11.40 | 11.99 | 13.90 | 13.85 | 14.42 | 12.88 | 14.01 |
| | CH505w100.B6D8gp120 | 11.04 | 11.77 | 13.62 | 13.91 | 14.47 | 12.58 | 13.82 |
| | CH505w100.B7D8gp120/293F | 11.58 | 11.53 | 13.14 | 13.62 | 14.04 | 12.28 | 13.27 |
| | CH505_w100V115b7.D7gp120/293F | 12.44 | 12.16 | 14.32 | 14.61 | 15.30 | 13.25 | 14.93 |
| | CH505w100.A10D8gp120 | 9.06 | 10.37 | 12.10 | 11.83 | 12.99 | 12.69 | 12.43 |
| | 505_w100.A4.D8.gp120/293F | 8.51 | 9.43 | 11.03 | 10.97 | 12.50 | 12.61 | 12.19 |
| | CH505_w100V115A10.D7gp120 | 9.20 | 10.79 | 12.90 | 12.73 | 13.65 | 13.70 | 12.79 |
| | CH505w100.A12D8gp120 | 9.56 | 9.65 | 12.26 | 12.81 | 12.90 | 9.01 | 13.17 |
| | CH505w100.A3D8gp120/293F | 7.21 | 8.59 | 11.91 | 11.99 | 10.84 | 11.19 | 11.45 |
| | CH505w100.A6D8gp120 | 10.12 | 11.11 | 12.23 | 12.53 | 12.74 | 11.93 | 12.39 |
| | CH505w100.B4D8gp120 | 11.91 | 12.55 | 12.48 | 13.29 | 13.35 | 12.56 | 13.00 |
| | CH505_w100V115A13.D7gp120/293F | 10.55 | 10.12 | 12.60 | 13.35 | 13.34 | 9.78 | 13.74 |
| | CH505_w100V115A6.D11gp120 | 12.24 | 11.93 | 13.62 | 14.17 | 14.54 | 13.15 | 14.09 |
| | CH505_w100V115B4.D11gp120 | 13.55 | 12.87 | 13.75 | 14.61 | 14.78 | 13.54 | 14.28 |
| | CH505w100.B2D8gp120/293F | 7.51 | 7.80 | 11.29 | 11.41 | 11.60 | 8.61 | 11.13 |

*Figure 60 cont.*

| | | CH103 Lineage | | | | | | | | | | | | | | |
|---|---|---|---|---|---|---|---|---|---|---|---|---|---|---|---|---|
| | Envelope ID | UCA | IA8 | IA7 | IA6 | IA4 | CH187 | CH188 | CH186 | CH200 | 1AH92U | IA3 | IA2 | IA1 | CH103 | CH104 |
| Week 136 | CH505w136.B18D8gp120 | 0.00 | 0.00 | 0.00 | 0.00 | 0.00 | 0.00 | 0.00 | 0.00 | 0.00 | 8.70 | 13.82 | 14.27 | 14.36 | 11.79 | 14.25 |
| | CH505w136.B2D8gp120/293F | 0.00 | 0.00 | 0.00 | 0.00 | 0.00 | 0.00 | 0.00 | 0.00 | 0.00 | 7.65 | 12.60 | 13.07 | 13.25 | 10.80 | 13.20 |
| | CH505_w137V201B12.D11gp120 | 0.00 | 0.00 | 0.00 | 0.00 | 0.00 | 0.00 | 0.00 | 0.00 | 0.00 | 11.40 | 11.13 | 12.81 | 12.50 | 12.90 | 12.17 |
| | CH505w136.B3D8gp120/293F | 0.00 | 0.00 | 0.00 | 0.00 | 0.00 | 0.00 | 0.00 | 0.00 | 0.22 | 5.00 | 12.05 | 13.06 | 13.10 | 9.93 | 13.10 |
| | CH505w136.B5D8gp120 | 0.00 | 0.00 | 0.00 | 0.00 | 0.00 | 0.00 | 0.00 | 0.00 | 0.00 | 0.13 | 8.59 | 9.94 | 9.48 | 4.33 | 10.59 |
| | CH505w136.B8D8gp120 | 0.00 | 0.00 | 0.00 | 0.00 | 0.00 | 0.00 | 0.00 | 0.00 | 0.00 | 11.49 | 11.80 | 13.23 | 12.94 | 11.90 | 11.73 |
| | CH505w136.B36D8gp120 | 0.00 | 0.00 | 0.00 | 0.00 | 0.00 | 0.00 | 0.00 | 0.00 | 0.00 | 12.04 | 12.76 | 13.63 | 13.76 | 13.75 | 13.84 |
| | CH505w136.B20D8gp120 | 0.00 | 0.00 | 0.00 | 0.00 | 0.00 | 0.00 | 0.00 | 0.00 | 0.00 | 11.08 | 11.21 | 12.70 | 12.40 | 12.43 | 11.66 |
| | CH505_w137V209C12.D11gp120 | 0.00 | 0.00 | 0.00 | 0.00 | 0.00 | 0.00 | 0.00 | 0.00 | 0.00 | 3.81 | 11.62 | 12.61 | 12.47 | 8.72 | 12.70 |
| | CH505w136.B27D8gp120 | 0.00 | 0.00 | 0.00 | 0.00 | 0.00 | 0.00 | 0.00 | 0.00 | 0.10 | 10.57 | 9.89 | 11.91 | 11.24 | 12.60 | 11.51 |
| | CH505w136.B29D8gp120 | 0.00 | 0.00 | 0.00 | 0.00 | 0.00 | 0.00 | 0.00 | 0.00 | 0.00 | 11.03 | 10.90 | 12.52 | 12.25 | 12.73 | 11.37 |
| | CH505w136.B4D8gp120 | 0.00 | 0.00 | 0.00 | 0.00 | 0.00 | 0.00 | 0.00 | 0.00 | 0.00 | 10.87 | 10.56 | 12.17 | 11.76 | 13.38 | 12.17 |
| | CH505w136.B12D8gp120 | 0.00 | 0.00 | 0.00 | 0.00 | 0.00 | 0.00 | 0.00 | 0.00 | 0.00 | 11.18 | 10.85 | 12.40 | 12.24 | 12.70 | 10.66 |
| | CH505w136.B10D8gp120 | 0.00 | 0.00 | 0.00 | 0.00 | 0.00 | 0.00 | 0.00 | 0.00 | 0.00 | 8.89 | 7.55 | 9.69 | 9.19 | 11.48 | 8.94 |
| Week 160 | CH505w160.T4D8gp120/293F | 0.00 | 0.00 | 0.00 | 0.00 | 0.00 | 0.00 | 0.00 | 0.00 | 0.00 | 4.84 | 12.55 | 13.44 | 13.55 | 9.03 | 12.85 |
| | CH505w160.C2D8gp120 | 0.00 | 0.00 | 0.00 | 0.00 | 0.00 | 0.00 | 0.00 | 0.00 | 0.00 | 9.64 | 9.07 | 10.09 | 9.62 | 12.16 | 9.24 |
| | CH505w160.C4D8gp120 | 0.00 | 0.00 | 0.00 | 0.00 | 0.00 | 0.00 | 0.00 | 0.00 | 0.00 | 7.65 | 3.88 | 6.15 | 5.26 | 12.19 | 7.23 |
| | CH505w160.C12D8gp120 | 0.00 | 0.00 | 0.00 | 0.00 | 0.00 | 0.00 | 0.00 | 0.00 | 0.00 | 3.05 | 12.02 | 12.90 | 12.91 | 7.76 | 11.33 |
| | CH505w160.C14D8gp120 | 0.00 | 0.00 | 0.00 | 0.00 | 0.00 | 0.00 | 0.00 | 0.00 | 0.00 | 7.86 | 5.43 | 7.05 | 5.84 | 12.15 | 6.83 |
| | CH505w160.A1D8gp120 | 0.00 | 0.00 | 0.00 | 0.00 | 0.00 | 0.00 | 0.00 | 0.00 | 0.00 | 7.68 | 5.85 | 7.58 | 6.35 | 10.71 | 7.31 |
| | CH505w160.C11D8gp120 | 0.00 | 0.00 | 0.00 | 0.00 | 0.00 | 0.00 | 0.00 | 0.00 | 0.00 | 8.93 | 6.73 | 8.53 | 7.70 | 11.89 | 7.44 |
| | CH505w160.D1D8gp120 | 0.00 | 0.00 | 0.00 | 0.00 | 0.00 | 0.00 | 0.00 | 0.00 | 0.00 | 8.20 | 5.15 | 7.34 | 6.39 | 11.50 | 5.71 |
| | CH505w160.D5D8gp120/293F | 0.00 | 0.00 | 0.00 | 0.00 | 0.00 | 0.00 | 0.00 | 0.00 | 0.00 | 7.32 | 3.03 | 4.99 | 3.78 | 10.95 | 4.51 |
| | CH505w160.T2D8gp120 | 0.00 | 0.00 | 0.00 | 0.00 | 0.00 | 0.00 | 0.00 | 0.00 | 0.00 | 7.56 | 3.82 | 5.64 | 4.68 | 11.15 | 5.41 |

*Figure 60 cont.*

| | | CH103 Lineage | | | | | | |
|---|---|---|---|---|---|---|---|---|
| | Envelope ID | CH105 | CH106 | CH243 | CH244 | CH245 | CH247 | CH248 |
| Week 136 | CH505w136.B18D8gp120 | 13.69 | 13.35 | 14.26 | 14.83 | 15.42 | 13.40 | 14.27 |
| | CH505w136.B2D8gp120/293F | 12.38 | 12.74 | 13.48 | 13.40 | 13.98 | 12.27 | 13.40 |
| | CH505_w137V201B12.D11gp120 | 10.96 | 12.53 | 13.17 | 13.91 | 14.34 | 13.53 | 13.41 |
| | CH505w136.B3D8gp120/293F | 12.00 | 12.57 | 13.71 | 14.11 | 14.30 | 13.17 | 13.97 |
| | CH505w136.B5D8gp120 | 10.55 | 10.90 | 13.19 | 14.39 | 14.35 | 13.33 | 14.55 |
| | CH505w136.B8D8gp120 | 9.86 | 11.71 | 10.95 | 12.28 | 12.32 | 11.97 | 12.29 |
| | CH505w136.B36D8gp120 | 12.82 | 13.09 | 14.06 | 14.72 | 15.30 | 14.43 | 14.37 |
| | CH505w136.B20D8gp120 | 10.66 | 12.09 | 13.02 | 13.10 | 13.50 | 12.53 | 12.92 |
| | CH505_w137V209C12.D11gp120 | 12.67 | 12.21 | 13.97 | 14.45 | 14.78 | 13.49 | 14.68 |
| | CH505w136.B27D8gp120 | 10.38 | 11.20 | 12.79 | 12.85 | 13.13 | 12.22 | 12.89 |
| | CH505w136.B29D8gp120 | 10.21 | 12.02 | 12.42 | 12.96 | 13.58 | 12.71 | 12.32 |
| | CH505w136.B4D8gp120 | 10.74 | 11.81 | 13.44 | 13.98 | 14.40 | 13.51 | 13.38 |
| | CH505w136.B12D8gp120 | 9.67 | 11.90 | 12.75 | 13.29 | 13.34 | 12.90 | 12.94 |
| | CH505w136.B10D8gp120 | 8.52 | 8.97 | 11.74 | 11.91 | 11.75 | 11.40 | 11.46 |
| Week 160 | CH505w160.T4D8gp120/293F | 12.21 | 12.33 | 13.39 | 13.89 | 14.23 | 12.29 | 13.52 |
| | CH505w160.C2D8gp120 | 8.61 | 9.29 | 11.24 | 11.88 | 10.53 | 11.47 | 11.09 |
| | CH505w160.C4D8gp120 | 6.55 | 6.80 | 10.61 | 12.06 | 9.83 | 11.17 | 10.48 |
| | CH505w160.C12D8gp120 | 11.14 | 12.17 | 12.09 | 12.61 | 12.05 | 11.82 | 12.89 |
| | CH505w160.C14D8gp120 | 6.58 | 6.94 | 11.03 | 12.24 | 10.05 | 11.80 | 10.29 |
| | CH505w160.A1D8gp120 | 6.66 | 7.60 | 9.67 | 9.63 | 8.96 | 9.31 | 8.62 |
| | CH505w160.C11D8gp120 | 7.70 | 8.15 | 10.91 | 11.50 | 10.40 | 11.36 | 10.67 |
| | CH505w160.D1D8gp120 | 6.03 | 7.06 | 9.51 | 10.81 | 8.34 | 10.47 | 8.75 |
| | CH505w160.D5D8gp120/293F | 4.58 | 5.64 | 8.57 | 10.05 | 7.32 | 10.29 | 7.84 |
| | CH505w160.T2D8gp120 | 4.94 | 6.16 | 9.14 | 10.83 | 7.85 | 10.31 | 8.34 |

*Figure 60 cont.*

| | | CH103 Lineage | | | | | | | | | | | | | | |
|---|---|---|---|---|---|---|---|---|---|---|---|---|---|---|---|---|
| | Envelope ID | UCA | IA8 | IA7 | IA6 | IA4 | CH187 | CH188 | CH186 | CH200 | 1AH92U | IA3 | IA2 | IA1 | CH103 | CH104 |
| | CH505.M5D8gp120293F | 0.00 | 0.57 | 2.33 | 3.30 | 3.76 | 9.44 | 9.01 | 12.22 | 8.90 | 6.12 | 6.88 | 7.79 | 7.04 | 9.84 | 9.02 |
| | CH505.M10D8gp120 | 1.35 | 4.68 | 8.82 | 9.18 | 9.78 | 12.67 | 12.64 | 13.93 | 10.46 | 11.08 | 11.37 | 11.75 | 11.08 | 13.25 | 11.68 |
| | CH505.M6D8gp120/293F | 5.23 | 7.05 | 10.46 | 10.70 | 10.89 | 12.67 | 12.60 | 13.82 | 9.64 | 11.89 | 11.87 | 12.07 | 11.79 | 13.09 | 11.58 |
| CH505 | CH505.M11D8gp120/293F | 2.62 | 6.22 | 10.13 | 10.04 | 10.46 | 12.61 | 13.02 | 13.63 | 10.52 | 11.82 | 11.92 | 12.67 | 12.19 | 13.38 | 12.03 |
| TF | CH505.M19D8gp120 | 1.74 | 5.03 | 8.41 | 8.38 | 9.53 | 13.55 | 13.78 | 13.53 | 10.31 | 9.99 | 9.79 | 11.71 | 11.30 | 13.29 | 11.26 |
| Mutants | CH505.M8D8gp120 | 0.00 | 0.79 | 3.65 | 4.92 | 5.40 | 11.41 | 11.30 | 12.29 | 9.12 | 9.00 | 8.85 | 9.97 | 9.49 | 11.52 | 10.11 |
| Loop D | CH505.M20D8gp120/293F | 0.00 | 0.68 | 3.59 | 5.21 | 5.58 | 11.86 | 12.04 | 13.27 | 10.75 | 9.66 | 9.92 | 10.78 | 10.38 | 12.21 | 10.85 |
| | CH505.M21D8gp120/293F | 0.00 | 0.66 | 3.45 | 5.12 | 5.51 | 10.82 | 11.04 | 11.47 | 10.24 | 10.07 | 10.94 | 11.59 | 11.22 | 11.40 | 11.23 |
| | CH505.M9D8gp120/293F | 0.12 | 1.33 | 4.88 | 5.73 | 6.33 | 11.65 | 11.70 | 13.46 | 8.96 | 9.77 | 9.52 | 10.35 | 9.85 | 11.60 | 10.84 |
| | CH505.M7D8gp120/293F | 0.44 | 2.23 | 4.38 | 5.34 | 6.39 | 11.26 | 11.15 | 12.94 | 7.36 | 9.06 | 7.73 | 9.31 | 8.70 | 11.06 | 9.73 |

*Figure 60 cont.*

| | Envelope ID | CH103 Lineage | | | | | | |
|---|---|---|---|---|---|---|---|---|
| | | CH105 | CH106 | CH243 | CH244 | CH245 | CH247 | CH248 |
| CH505 TF | CH505.M5D8gp120/293F | 8.63 | 8.37 | 10.41 | 10.38 | 10.74 | 11.47 | 10.98 |
| | CH505.M10D8gp120 | 11.30 | 11.81 | 13.61 | 13.40 | 13.74 | 13.09 | 13.77 |
| | CH505.M6D8gp120/293F | 11.05 | 12.60 | 13.65 | 13.24 | 13.62 | 13.57 | 13.64 |
| | CH505.M11D8gp120/293F | 11.72 | 12.77 | 13.97 | 13.66 | 13.76 | 13.67 | 13.64 |
| | CH505.M19D8gp120 | 10.92 | 12.18 | 13.79 | 13.72 | 14.06 | 13.82 | 13.21 |
| Mutants | CH505.M8D8gp120 | 9.33 | 10.19 | 11.50 | 11.57 | 11.51 | 12.61 | 12.32 |
| Loop D | CH505.M20D8gp120/293F | 10.57 | 10.69 | 12.82 | 12.66 | 12.57 | 13.39 | 13.20 |
| | CH505.M21D8gp120/293F | 11.19 | 11.46 | 13.41 | 13.05 | 12.66 | 13.31 | 13.78 |
| | CH505.M9D8gp120/293F | 10.58 | 10.98 | 13.04 | 12.95 | 13.07 | 12.54 | 13.01 |
| | CH505.M7D8gp120/293F | 10.17 | 10.99 | 12.85 | 12.35 | 12.37 | 12.49 | 12.42 |

*Figure 60 cont.*

Disulfide bonds to keep CD4 from altering structure

SOSIP.I--The DS mutation was added to the chimeric CH505 SOSIP

- Used site-directed mutagenesis to remove the cysteines.
- The naturally occurring residues were used to replace the two cysteines.

PGT 151
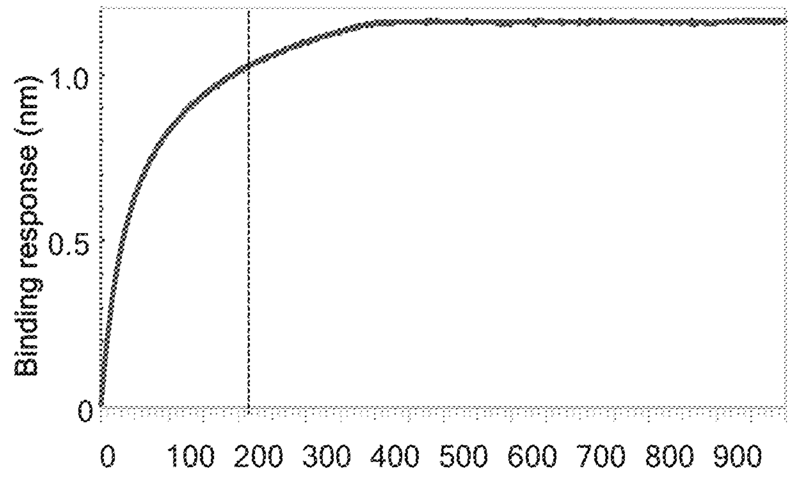
CH505 TF chimeric SOSIP.III
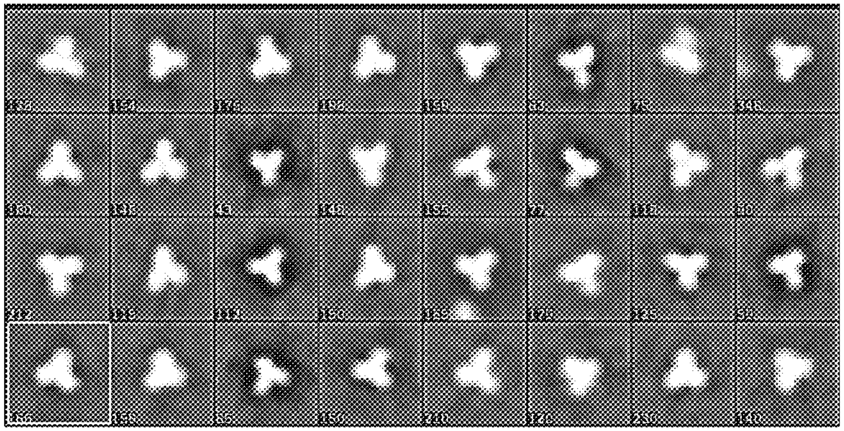
The glycosylation and disulfide bonds analysis is underway and for the completed Envs appears as expected.
Figure 68

| CH103 clonal lineage<br>Neutralization titer and binding affinity to<br>CH505 TF virus and SOSIP.III | | | | | | | |
|---|---|---|---|---|---|---|---|
| | UCA | IA_8 | IA_4 | IA_3.1 | IA_2 | IA_1 | CH106 |
| IC50 | >50 | 49.4 | 10.9 | 6.2 | 1.5 | 2.5 | 2.3 |
| $K_d$ | 171 | 109 | 28 | 4.1 | 6.2 | <1 | <1 |

COMPOSITIONS COMPRISING HIV ENVELOPES TO INDUCE CH235 LINEAGE ANTIBODIES

This application is a U.S. National Stage application under 35 U.S.C. § 371 of International Patent Application No. PCT/US2017/020249, filed Mar. 1, 2017 which claims the benefit of and priority to U.S. Provisional Application No. 62/302,017 filed on Mar. 1, 2016 and U.S. Provisional Application No. 62/403,503 filed on Oct. 3, 2016. The entire contents of each of these applications are incorporated herein by reference in their entirety.

This invention was made with government support under Center for HIV/AIDS Vaccine Immunology-Immunogen Design grant UM1-AI100645 from the NIH, NIAID, Division of AIDS. The government has certain rights in the invention. The United States government also has rights in this invention pursuant to Contract No. DE-AC52-06NA25396 between the United States Department of Energy and Los Alamos National Security, LLC for the operation of Los Alamos National Laboratory.

SEQUENCE LISTING

The instant application contains a Sequence Listing which has been filed electronically in ASCII format and is hereby incorporated by reference in its entirety. Said ASCII copy, created on Aug. 20, 2020, is named 1234300_300_US2_SL.txt and is 1,240,139 bytes in size.

TECHNICAL FIELD

The present invention relates in general, to a composition suitable for use in inducing anti-HIV-1 antibodies, and, in particular, to immunogenic compositions comprising envelope proteins and nucleic acids to induce cross-reactive neutralizing antibodies and increase their breadth of coverage. The invention also relates to methods of inducing such broadly neutralizing anti-HIV-1 antibodies using such compositions.

BACKGROUND

The development of a safe and effective HIV-1 vaccine is one of the highest priorities of the scientific community working on the HIV-1 epidemic. While anti-retroviral treatment (ART) has dramatically prolonged the lives of HIV-1 infected patients, ART is not routinely available in developing countries.

SUMMARY OF THE INVENTION

In certain embodiments, the invention provides compositions and method for induction of immune response, for example cross-reactive (broadly) neutralizing Ab induction. In certain embodiments, the methods use compositions comprising "swarms" of sequentially evolved envelope viruses that occur in the setting of bnAb generation in vivo in HIV-1 infection.

In certain aspects the invention provides compositions comprising a selection of HIV-1 envelopes and/or nucleic acids encoding these envelopes as described herein for example but not limited to Selections as described herein. Without limitations, these selected combinations comprise envelopes which provide representation of the sequence (genetic) and antigenic diversity of the HIV-1 envelope variants which lead to the induction and maturation of the CH103 and CH235 antibody lineages. In certain embodiments the selections of envelopes comprise envelopes which show differential binding to an antibody or antibodies from CH103 and CH235 lineages (FIGS. 14-16, FIGS. 17-24). Non-limiting embodiments of various selections of immunogens are described in Example 3. In certain embodiments, these compositions are used in immunization methods as a prime and/or boost.

In certain embodiments the selections of envelopes comprise envelopes which show differential binding to an antibody or antibodies from CH103 and CH235 lineages (FIGS. 14-16, FIGS. 17-24). In certain aspects, the invention provides a kit comprising a combination/selection of immunogens of Example 3. In some embodiments the selection of immunogens is selection F, selection G, or selection H. In some embodiments the kit comprises instructions on how to carry out the immunization regimen. In some embodiments the kit comprises instructions on administration of the selection of immunogens as a prime or boost as part of a prime/boost immunization regimen. In certain aspects, the invention provides a kit comprising any one of the immunogens of Example 3, or in selection F, G, or H and instructions on how to carry out an immunization regimen with the immunogen of the kit, including which immunogen(s) are a prime immunization and which immunogen(s) comprise a boost immunization. In some embodiments the kit comprises instructions on administration of the immunogen as a prime or as a boost as part of a prime/boost immunization regimen. In some embodiments the immunogen could be administered sequentially or additively.

In certain aspects, the invention provides a kit comprising Env M5, M11, 20.14, 30.20, 30.12, 30.21 30.23, 30.25, 30.28, 53.25, 53.29, 53.31, 78.15, 100.B6 and/or 136.B18. In some embodiments the kit comprises instructions on how to carry out the immunization regimen, including which immunogen(s) are a prime immunization and which immunogen(s) comprise a boost immunization. In some embodiments the kit comprises instructions on administration of the immunogen as a prime or as a boost as part of a prime/boost immunization regimen.

In some embodiments, the kit comprises Env M5, M11, w20.14, w30.20 and/or w136.B18 and instructions on administration of the immunogen as a prime or boost as part of a prime/boost immunization regimen with M5, M11, w20.14, w30.20 and/or w136.B18, including which immunogen(s) are a prime immunization and which immunogen(s) comprise a boost immunization In some embodiments, the kit comprises Env M5, w30.25, w53.25 and/or w53.29 and instructions on administration of the immunogen as a prime or boost as part of a prime/boost immunization regimen with M5, w30.25, w53.25 and/or w53.29, including which immunogen(s) are a prime immunization and which immunogen(s) comprise a boost immunization.

In one aspect the invention provides selections of envelopes from individual CH505, which selections can be used in compositions for immunizations to induce lineages of broad neutralizing antibodies. In certain embodiments, there is some variance in the immunization regimen; in some embodiments, the selection of HIV-1 envelopes may be grouped in various combinations of primes and boosts, either as nucleic acids, proteins, or combinations thereof. In certain embodiments the compositions are pharmaceutical compositions which are immunogenic. In certain embodiments, the compositions comprise amounts of envelopes which are therapeutic and/or immunogenic.

In one aspect the invention provides a composition for a prime boost immunization regimen comprising any one of the envelopes described herein, or any combination thereof wherein the envelope is a prime or boost immunogen. In certain embodiments the composition for a prime boost immunization regimen comprises one or more envelopes from FIGS. 14-16, FIGS. 17-24, Example 3, or from immunogen selection F, selection G, or selection H. In some embodiments, the composition for a prime boost immunization regimen comprises one or more envelopes M5, M11, 20.14, 30.20, 30.12, 30.21 30.23, 30.25, 30.28, 53.25, 53.29, 53.31, 78.15, 100.B6 and/or 136.B18.

In one aspect the invention provides a composition comprising any one of the envelopes described herein, or any combination thereof—for example but not limited to selections in Examples and FIGS. 14, 15, 16, 17-24. In other aspects, the invention provides use of these selections of envelopes in methods to induce an immune response. In non-limiting embodiments the envelope selections induce antibodies in the CH235 lineage, for example antibody CH557, (described in Example 8).

In some embodiments, CH505 M11 Env is administered first as a prime, followed by a mixture of a next group of Envs. In some embodiments, grouping of the envelopes is based on their binding affinity for the antibodies expected to be induced. In some embodiments, grouping of the envelopes is based on chronological evolution of envelope viruses that occurs in the setting of bnAb generation in vivo in HIV-1 infection. In some embodiments Loop D mutants could be included in either prime and/or boost. In some embodiments, the composition comprises an adjuvant. In some embodiments, the composition and methods comprise use of agents for transient modulation of the host immune response.

In one aspect the invention provides a composition comprising nucleic acids encoding HIV-1 envelope which is a loop D mutant, e.g. M11 or any other suitable D loop mutant or combination thereof, e.g. M11 and M5.

In another aspect the invention provides a method of inducing an immune response in a subject comprising administering a composition comprising HIV-1 envelope M11 and/or M5 as a prime in an amount sufficient to induce an immune response, wherein the envelope is administered as a polypeptide or a nucleic acid encoding the same. A method of inducing an immune response in a subject comprising administering a composition comprising HIV-1 envelope M11 and M5 as a prime in an amount sufficient to induce an immune response, wherein the envelope is administered as a polypeptide or a nucleic acid encoding the same.

In certain embodiments the methods comprise administering any of the selection listed in Example 3. In certain embodiments the methods comprise administering Envs M5, M11, 20.14, 30.28, 30.23, and/or 136.B18. In certain embodiments the methods comprise administering Envs M5, M11, 20.14, 30.20, 30.23, and/or 136.B18. In certain embodiments the methods comprise administering Envs M5, M11, 20.14, 30.20, 30.12, and/or 136.B18. In certain embodiments the methods comprise administering envelopes M5, 30.25, 53.25, and/or 53.29.

In certain embodiments the methods further comprise administering a composition comprising any one of HIV-1 envelope M11, w020.14, w030.28, w078.15, w053.31 or any combination thereof as a boost, wherein the envelope is administered as a polypeptide or a nucleic acid encoding the same.

In certain embodiments the methods comprise administering a composition comprising any one of HIV-1 envelope M11, M5, w020.14, w030.28, w078.15, w053.31 or any combination thereof as a boost, wherein the envelope is administered as a polypeptide or a nucleic acid encoding the same.

In another aspect the invention provides a method of inducing an immune response in a subject comprising administering a composition comprising HIV-1 envelope M11, M5, w020.14, w030.28, w078.15, w053.16, w030.21, w078.33, w100.B6, w053.31 or any combination thereof as a prime and/or boost in an amount sufficient to induce an immune response, wherein the envelope is administered as a polypeptide or a nucleic acid encoding the same.

In certain embodiments, the compositions contemplate nucleic acid, as DNA and/or RNA, or proteins immunogens either alone or in any combination. In certain embodiments, the methods contemplate genetic, as DNA and/or RNA, immunization either alone or in combination with envelope protein(s).

In certain embodiments the nucleic acid encoding an envelope is operably linked to a promoter inserted an expression vector. In certain aspects the compositions comprise a suitable carrier. In certain aspects the compositions comprise a suitable adjuvant.

In certain embodiments the induced immune response includes induction of antibodies, including but not limited to autologous and/or cross-reactive (broadly) neutralizing antibodies against HIV-1 envelope. Various assays that analyze whether an immunogenic composition induces an immune response, and the type of antibodies induced are known in the art and are also described herein.

In certain aspects the invention provides an expression vector comprising any of the nucleic acid sequences of the invention, wherein the nucleic acid is operably linked to a promoter. In certain aspects the invention provides an expression vector comprising a nucleic acid sequence encoding any of the polypeptides of the invention, wherein the nucleic acid is operably linked to a promoter. In certain embodiments, the nucleic acids are codon optimized for expression in a mammalian cell, in vivo or in vitro. In certain aspects the invention provides nucleic acids comprising any one of the nucleic acid sequences of invention. In certain aspects the invention provides nucleic acids consisting essentially of any one of the nucleic acid sequences of invention. In certain aspects the invention provides nucleic acids consisting of any one of the nucleic acid sequences of invention. In certain embodiments the nucleic acid of the invention, is operably linked to a promoter and is inserted in an expression vector. In certain aspects the invention provides an immunogenic composition comprising the expression vector.

In certain aspects the invention provides a composition comprising at least one of the nucleic acid sequences of the invention. In certain aspects the invention provides a composition comprising any one of the nucleic acid sequences of invention. In certain aspects the invention provides a composition comprising at least one nucleic acid sequence encoding any one of the polypeptides of the invention.

In certain aspects the invention provides a composition comprising at least one nucleic acid encoding HIV-1 envelope M11, M5, w020.14, w030.28, w078.15, w053.16, w030.21, w078.33, w100.B6, w053.31 or any combination thereof. Non-limiting examples of combinations are shown in Example 2.

In certain embodiments, the compositions and methods employ an HIV-1 envelope as polypeptide instead of a nucleic acid sequence encoding the HIV-1 envelope. In certain embodiments, the compositions and methods employ an HIV-1 envelope as polypeptide, a nucleic acid sequence encoding the HIV-1 envelope, or a combination thereof.

The envelope used in the compositions and methods of the invention can be a gp160, gp150, gp145, gp140, gp120, gp41, N-terminal deletion variants as described herein, cleavage resistant variants as described herein, or codon optimized sequences thereof. In certain embodiments the composition comprises envelopes as trimers. In certain embodiments, envelope proteins are multimerized, for example trimers are attached to a particle such that multiple copies of the trimer are attached and the multimerized envelope is prepared and formulated for immunization in a human. In certain embodiments, the compositions comprise envelopes, including but not limited to trimers as particulate, high-density array on liposomes or other particles, for example but not limited to nanoparticles. In some embodiments, the trimers are in a well ordered, near native like or closed conformation. In some embodiments the trimer compositions comprise a homogenous mix of native like trimers. In some embodiments the trimer compositions comprise at least 85%, 90%, 95% native like trimers.

The polypeptide contemplated by the invention can be a polypeptide comprising any one of the polypeptides described herein. The polypeptide contemplated by the invention can be a polypeptide consisting essentially of any one of the polypeptides described herein. The polypeptide contemplated by the invention can be a polypeptide consisting of any one of the polypeptides described herein. In certain embodiments, the polypeptide is recombinantly produced. In certain embodiments, the polypeptides and nucleic acids of the invention are suitable for use as an immunogen, for example to be administered in a human subject.

In certain embodiments the envelope is any of the forms of HIV-1 envelope. In certain embodiments the envelope is gp120, gp140, gp145 (i.e. with a transmembrane), gp150. In certain embodiments, gp140 designed to form a stable trimer (See Table 1, FIGS. 22-24, Example 9 for non-limiting examples of sequences of stable trimer designs). In certain embodiments envelope protomers from a trimer which is not a SOSIP timer. In certain embodiment the trimer is a SOSIP based trimer wherein each protomer comprises additional modifications. In certain embodiments, envelope trimers are recombinantly produced. In certain embodiments, envelope trimers are purified from cellular recombinant fractions by antibody binding and reconstituted in lipid comprising formulations. See for example WO2015/127108 titled "Trimeric HIV-1 envelopes and uses thereof" which content is herein incorporated by reference in its entirety. In certain embodiments the envelopes of the invention are engineered and comprise non-naturally occurring modifications.

In certain embodiments, the envelope is in a liposome. In certain embodiments the envelope comprises a transmembrane domain with a cytoplasmic tail embedded in a liposome. In certain embodiments, the nucleic acid comprises a nucleic acid sequence which encodes a gp120, gp140, gp145, gp150, gp160.

In certain embodiments, where the nucleic acids are operably linked to a promoter and inserted in a vector, the vectors is any suitable vector. Non-limiting examples, include, VSV, replicating rAdenovirus type 4, MVA, Chimp adenovirus vectors, pox vectors, and the like. In certain embodiments, the nucleic acids are administered in NanoTaxi block polymer nanospheres. In certain embodiments, the composition and methods comprise an adjuvant. Non-limiting examples include, AS01 B, AS01 E, gla/SE, alum, Poly I poly C (poly IC), polyIC/long chain (LC) TLR agonists, TLR7/8 and 9 agonists, or a combination of TLR7/8 and TLR9 agonists (see Moody et al. (2014) J. Virol. March 2014 vol. 88 no. 6 3329-3339), or any other adjuvant. Non-limiting examples of TLR7/8 agonist include TLR7/8 ligands, Gardiquimod, Imiquimod and R848 (resiquimod). A non-limiting embodiment of a combination of TLR7/8 and TLR9 agonist comprises R848 and oCpG in STS (see Moody et al. (2014) J. Virol. March 2014 vol. 88 no. 6 3329-3339).

In certain aspects the invention provides a cell comprising a nucleic acid encoding any one of the envelopes of the invention suitable for recombinant expression. In certain aspects, the invention provides a clonally derived population of cells encoding any one of the envelopes of the invention suitable for recombinant expression. In certain aspects, the invention provides a sable pool of cells encoding any one of the envelopes of the invention suitable for recombinant expression.

In certain aspects, the invention provides a recombinant HIV-1 envelope polypeptide from Table 1, wherein the polypeptide is a non-naturally occurring protomer designed to form an envelope trimer. The invention also provides nucleic acids encoding these recombinant polypeptide. Non-limiting examples of amino acids and nucleic acid of such protomers are shown in FIGS. 22-24.

In certain aspects the invention provides a recombinant trimer comprising three identical protomers of an envelope from Table 1. In certain aspects the invention provides an immunogenic composition comprising the recombinant trimer and a carrier, wherein the trimer comprises three identical protomers of an HIV-1 envelope listed in Table 1. In certain aspects the invention provides an immunogenic composition comprising nucleic acid encoding these recombinant HIV-1 envelope and a carrier.

In certain aspects the invention provides a selection of HIV-1 envelopes or any suitable form of a nucleic acid encoding HIV-1 envelope for use in an immunization regimen, wherein the selections of envelopes comprises envelopes M5, M11, w20.14, w30.20, w30.12, and w136.B18 (Selection F, e.g. listed in FIG. 18A) or any combination thereof, envelopes M5, w30.25, w53.25, and w53.29 (Selection G, e.g. FIG. 20) or any combination thereof, envelopes M5, w30.20, w20.14, and w30.12 (Selection H, e.g. FIG. 21) or any combination thereof. In certain aspects the invention provides a selection of HIV-1 envelopes for immunization wherein the HIV-1 envelope is a loop D mutant envelope M5 and/or M11. In certain embodiments the prime is M5.

In certain aspects the invention provides a selection of nucleic acids encoding HIV-1 envelopes for immunization wherein the nucleic acid encodes a gp120 envelope, gp120D8 envelope, a gp140 envelope (gp140C, gp140CF, gp140CFI) as soluble or stabilized protomer of a SOSIP trimer, a gp145 envelope, a gp150 envelope, or a transmembrane bound envelope.

In certain aspects the invention provides a selection of HIV-1 envelopes for immunization wherein the HIV-1 envelope is a gp120 envelope or a gp120D8 variant. In certain embodiments a composition for immunization comprises protomers that form stabilized SOSIP.III trimers.

In certain embodiments, the compositions for use in immunization further comprise an adjuvant.

In certain embodiments, wherein the compositions comprise a nucleic acid, the nucleic acid is operably linked to a promoter, and could be inserted in an expression vector.

In certain aspects, the invention provides a kit comprising a combination/selection of immunogens of from Table 1, wherein the polypeptide is a non-naturally occurring protomer designed to form an envelope trimer. In certain aspects, the invention provides a kit comprising a combination/selection of immunogens of from FIGS. 22-24. In some embodiments the kit comprises instructions on how to carry out the immunization regimen, including which immunogen(s) are a prime immunization and which immunogen(s) comprise a boost immunization. In some embodiments the kit comprises instructions on administration of the selection of immunogens as a prime or boost as part of a prime/boost immunization regimen. In certain aspects, the invention provides a kit comprising any one of the immunogens from Table 1, wherein the polypeptide is a non-naturally occurring protomer designed to form an envelope trimer and instructions on how to carry out an immunization regimen with the immunogen of the kit. In some embodiments the kit comprises instructions on administration of the immunogen as a prime or as a boost as part of a prime/boost immunization regimen. In some embodiments the immunogen could be administered sequentially or additively. In certain aspects, the invention provides a kit comprising a combination/selection of immunogens of from FIGS. 22-24.

In one aspect the invention provides a composition for a prime boost immunization regimen comprising one or more envelopes from Table 1, wherein the polypeptide is a non-naturally occurring protomer designed to form an envelope trimer, wherein the envelope is a prime or boost immunogen. In one aspect the invention provides a composition for a prime boost immunization regimen comprising one or more envelopes from FIGS. 22-24 wherein the envelope is a prime or boost immunogen.

In certain aspects the invention provides methods of inducing an immune response in a subject comprising administering a composition comprising any suitable form of a nucleic acid(s) encoding an HIV-1 envelope(s) in an amount sufficient to induce an immune response from one or more of the following groups: (a) the selection of envelopes M5, M11, w20.14, w30.20, w30.12, and w136.B18 (Selection F, e.g. listed in FIG. 18A) or any combination thereof, (b) envelopes M5, w30.25, w53.25, and w53.29 (Selection G, e.g. FIG. 20) or any combination thereof, (c) envelopes M5, w30.20, w20.14, and w30.12 (Selection H, e.g. FIG. 21) or any combination thereof and wherein the administration step can alternatively, or in addition, comprise administering an HIV-1 polypeptide(s) in an amount sufficient to induce an immune response from one or more of the following groups: (a) envelopes M5, M11, w20.14, w30.20, w30.12, and w136.B18 (Selection F, e.g. listed in FIG. 18A) or any combination thereof; (b) envelopes M5, w30.25, w53.25, and w53.29 (Selection G, e.g. FIG. 20) or any combination thereof, (c) envelopes M5, w30.20, w20.14, and w30.12 (Selection H, e.g. FIG. 21) or any combination thereof. In certain embodiments, the composition comprises M5 or a nucleic acid encoding M5 that is administered as a prime immunogen. In certain embodiments, the methods further comprise administering M11 or a nucleic acid encoding M11. In certain embodiments, the methods further comprise administering HIV-1 envelope w20.14 or a nucleic acid encoding HIV-1 envelope w20.14, followed by administering HIV-1 envelope w30.20 or a nucleic acid encoding HIV-1 envelope w30.20, and followed by administering HIV-1 envelope w30.12 or a nucleic acid encoding HIV-1 envelope w30.12. In certain embodiments, the methods further comprise administering HIV-1 envelope w136.B18 or a nucleic acid encoding HIV-1 envelope w136.B18.

In certain embodiments, the methods further comprise administering HIV-1 envelope w30.25 or a nucleic acid encoding HIV-1 envelope w30.25, HIV-1 envelope w53.25 or a nucleic acid encoding HIV-1 envelope w53.25, HIV-1 envelope w53.29 or a nucleic acid encoding HIV-1 envelope w53.29.

In certain embodiments, the nucleic acid encodes a gp120 envelope, gp120D8 envelope, a gp140 envelope (gp140C, gp140CF, gp140CFI) as soluble or stabilized protomer of a SOSIP trimer, a gp145 envelope, a gp150 envelope, or a transmembrane bound envelope. In certain embodiments, the polypeptide is gp120 envelope, gp120D8 envelope, a gp140 envelope (gp140C, gp140CF, gp140CFI) as soluble or stabilized protomer of a SOSIP trimer, a gp145 envelope, a gp150 envelope, or a transmembrane bound envelope.

In certain aspects, the invention provides a method of inducing an immune response in a subject comprising administering a composition comprising envelope CH505 T/F, followed by envelope w53.16, followed by envelope w78.33 and followed by envelope w100.B6, wherein each composition comprises the envelope as a trimer. In certain embodiments of the method the selection of immunogens is administered as nucleic acids.

In certain embodiments, the methods comprise administering an adjuvant. In certain embodiments, the methods comprise administering an agent which modulates host immune tolerance. In certain embodiments, the administered polypeptide is multimerized in a liposome or nanoparticle. In certain embodiments, the methods comprise administering one or more additional HIV-1 immunogens to induce a T cell response. Non-limiting examples include gag, nef, pol, etc.

In certain aspects, the invention provides a recombinant HIV-1 Env ectodomain trimer, comprising three gp120-gp41 protomers comprising a gp120 polypeptide and a gp41 ectodomain, wherein each protomer is the same and each protomer comprises portions from envelope BG505 HIV-1 strain and gp120 polypeptide portions from a CH505 HIV-1 strain and stabilizing mutations A316W and E64K, (see e.g. FIG. 23). In certain embodiments, the trimer is stabilized in a prefusion mature closed conformation, and wherein the trimer does not comprise non-natural disulfide bond between cysteine substitutions at positions 201 and 433 of the HXB2 reference sequence. Non-limited examples of envelopes contemplated as trimers are listed in Table 1. In some embodiments, the amino acid sequence of one monomer comprised in the trimer is shown in FIG. 22-24. In some embodiments, the trimer is immunogenic. In some embodiments the trimer binds to any one of the antibodies PGT145, PGT151, CH103UCA, CH103, VRC01, PGT128, or any combination thereof. In some embodiments the trimer does not bind to antibody 19B and/or 17B.

In certain aspects, the invention provides a pharmaceutical composition comprising any one of the recombinant trimers of the invention. In certain embodiments the compositions comprising trimers are immunogenic. The percent trimer in such immunogenic compositions could vary. In some embodiments the composition comprises 70%, 71%, 72%, 73%, 74%, 75%, 76%, 77%, 78%, 79%, 80%, 81%, 82%, 83%, 84%, 85%, 86%, 87%, 89%, 90%, 91%, 92%, 93%, 94%, 95%, 96%, 97%, 98%, 99% stabilized trimer.

In certain aspects the invention provides any suitable form of a nucleic acid encoding a HIV-1 envelope from the selections of envelopes listed in FIG. 14A (envelopes M5, M11, 20.14, 30.28, 30.23. and 136.B18), FIG. 15A (envelopes M5, M11, 20.14, 30.20, 30.23. and 136.B18), FIG. 16A (envelopes M5, M11, 20.14, 30.20, 30.12. and 136.B18), FIG. 18A (envelopes M5, M11, 20.14, 30.20, 30.12, and 136.B18), FIG. 20 (M5, 30.25; 53.25; and 53.29), FIG. 21 (M5, w30.20, w20.14, w30.12), or any combination thereof. In certain embodiments the envelopes bind preferentially to an antibody or antibodies from CH103 lineage. In certain embodiments the envelopes bind preferentially to an antibody or antibodies from CH235 lineage. In certain aspects the invention provides a polypeptide from the selections of envelopes listed in FIG. 14A (envelopes M5, M11, 20.14, 30.28, 30.23. and 136.B18), FIG. 15A (envelopes M5, M11, 20.14, 30.20, 30.23. and 136.B18), FIG. 16A (envelopes M5, M11, 20.14, 30.20, 30.12. and 136.B18), FIG. 18A (envelopes M5, M11, 20.14, 30.20, 30.12, and 136.B18), FIG. 20 (M5, 30.25; 53.25; and 53.29), FIG. 21 (M5, w30.20, w20.14, w30.12), or any combination thereof. In certain aspects the invention provides a composition comprising any suitable form of the nucleic acids of the invention. In certain aspects the invention provides a composition comprising any suitable polypeptide, wherein the polypeptide is engineered and recombinantly produced.

BRIEF DESCRIPTION OF THE DRAWINGS

The patent or application file contains at least one drawing executed in color. To conform to the requirements for PCT patent applications, many of the figures presented herein are black and white representations of images originally created in color.

FIG. 1 shows sequences of six envelopes (SEQ ID NOS 19-67, respectively, in order of appearance): CH505.M5gp145, CH505.M11gp145, CH505w020.14gp145, CH505w030.28gp145, CH505w078.15gp145, CH505w053.31gp145, also as gp120D8 and gp160 amino acid and nucleic acid sequences.

FIG. 2A shows sequences of ten envelopes (SEQ ID NOS 68-98, respectively, in order of appearance): CH505.M5gp145, CH505.M11gp145, CH505w020.14gp145, CH505w030.28gp145, CH505w078.15gp145, CH505w53.16gp145, CH505w30.21gp145, CH505w78.33gp145, CH505w100.B6gp145, CH505w053.31gp145, amino acid and nucleic acid sequences.

FIG. 2B shows sequences of ten envelopes (SEQ ID NOS 99-124, respectively, in order of appearance): CH505.M5D8gp120, CH505.M11D8gp120, CH505w020.14D8gp120, CH505w030.28D8gp120, CH505w078.15D8gp120, CH505w053.16D8gp120, CH505w030.21D8gp120, CH505w078.33D8gp120, CH505w100.B6D8gp120, CH505w053.31D8gp120 as amino acids and nucleic acids.

FIG. 2C shows sequences of ten envelopes of FIG. 2B as gp160 amino acid and nucleic acid sequences (SEQ ID NOS 125-144, respectively, in order of appearance).

FIG. 9 shows neutralization activity of CH103 clonal lineage antibodies against autologous CH505 viruses.

FIG. 10 shows neutralization susceptibility of the CH505 loop D mutants to CH103 lineage antibodies.

FIG. 12 shows neutralization susceptibility of CH505 loop D mutants to CH235 lineage antibodies.

FIG. 13 shows neutralization activity of CH235 clonal lineage antibodies against autologous CH505 viruses.

FIGS. 16A-B show a binding log Area Under the Curve, AUC) of Sequential Envs M5, M11, 20.14, 30.20, 30.12, 136.B18 to CH103 (FIG. 16B) and CH235 (FIG. 16A- includes lineage member CH557) CD4 Binding Site Broadly Neutralizing Antibody Lineages members.

FIGS. 17A-B show amino acid and nucleic acid sequences of M5, M11, 20.14, 30.20, 30.12, 136.B18 envelopes: FIG. 17A shows sequences of gp120D8 variants (SEQ ID NOS 145-156, respectively, in order of appearance), FIG. 17B shows sequences of gp160 envelopes (SEQ ID NOS 157-168, respectively, in order of appearance).

Figure 3A:
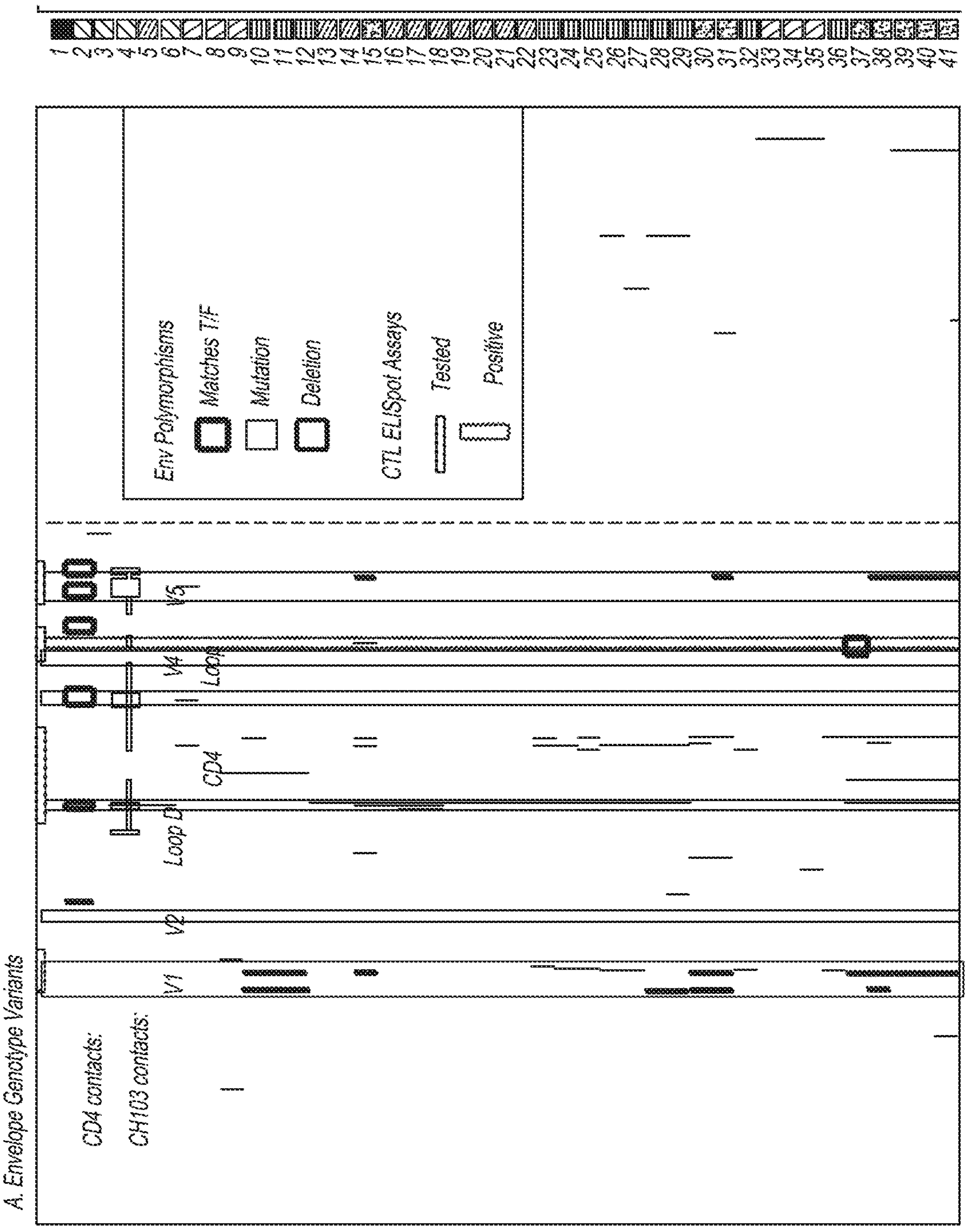
FIGS. 3A-C shows the genotype variation (A, left panel), neutralization titers (B, center panel), and Envelope phylogenetic relations (C, right panel) among CH505 Envelope variants. The vertical position in each panel corresponds to the same CH505 Env clone named on the right side of the tree. Distance from the Transmitted/Founder form generally increases from top towards bottom of the figure. In the left panel (A), sites not colored correspond to the Transmitted/Founder virus, thin boxed sites show mutations, and hashed boxed sites correspond to insertions or deletions relative to the Transmitted/Founder virus. Additional annotation indicates the known CD4 binding-site contacts (short, vertical black bars towards top), CH103 binding-site contacts for the resolved structure (short, vertical transparent bars with a horizontal line to indicate the region resolved by X-Ray Crystallography), gp120 landmarks (vertical boxed rectangular regions, V1-V5 hypervariable loops, Loop D, and CD4 Loops), a dashed vertical line delineating the gp120/gp41 boundary, and results from testing for CTL epitopes with ELISpot assays (lined rectangle at top and bottom show where peptides were tested and negative, and a wavy rectangle for the tested positive region outside the C-terminal end of V4). The center panel (B) depicts IC50 (50% inhibitory concentrations, in μg/ml) values from autologous neutralization assays against 13 monoclonal antibodies (MAbs) of the CH103 lineage and each of 134 CH505 Env-pseudotyped viruses. Hashing scale values indicate neutralization potency and range from speckled (no neutralization detected) through wide left-to-right diagonal hashed (potent neutralization, i.e. <0.2 μg/ml; empty cells correspond to absence of information). The cumulative progression of neutralization potency from left to right, corresponding to developmental stages in the CH103 lineage, indicates accumulation of neutralization potency. Similarly, increased presence neutralization signal from top to bottom corresponds to increasing neutralization breadth per MAb in the CH103 lineage. In the right-most panel (C) is the phylogeny of CH505 Envs, with the x-axis indicating distance from the Transmitted-Founder virus per the scale bar (units are mutations per site). The tree is ordered vertically such that lineages with the most descendants appear towards the bottom. Each leaf on the tree corresponds to a CH505 autologous Env, with the name of the sequence depicted ('w' and symbol hash pattern indicate the sample time-point; 'M' indicates a synthetic mutant Env). The hash pattern of the corresponding diamond(s) to the left of each leaf name indicates its inclusion in a possible embodiment, or no diamond for exclusion from any embodiments described herein. Three long, vertical lines to the left of the tree depict the phylogenetic distribution of envelopes in three distinct alternative embodiments (identified as "Vaccination Regimes 1-3"), with diamonds used to identify each.
Figure 3A:
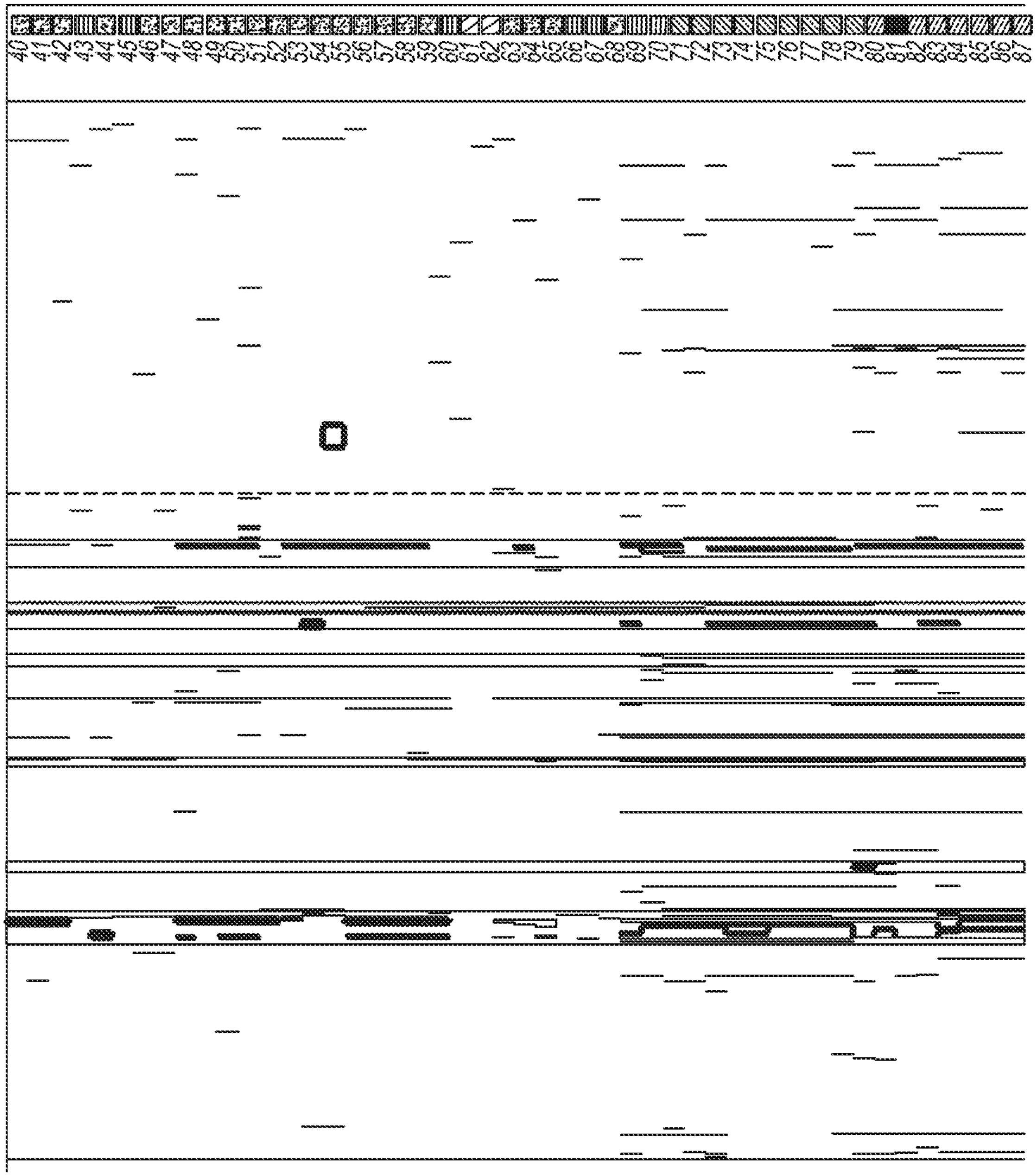
Figure 3A:
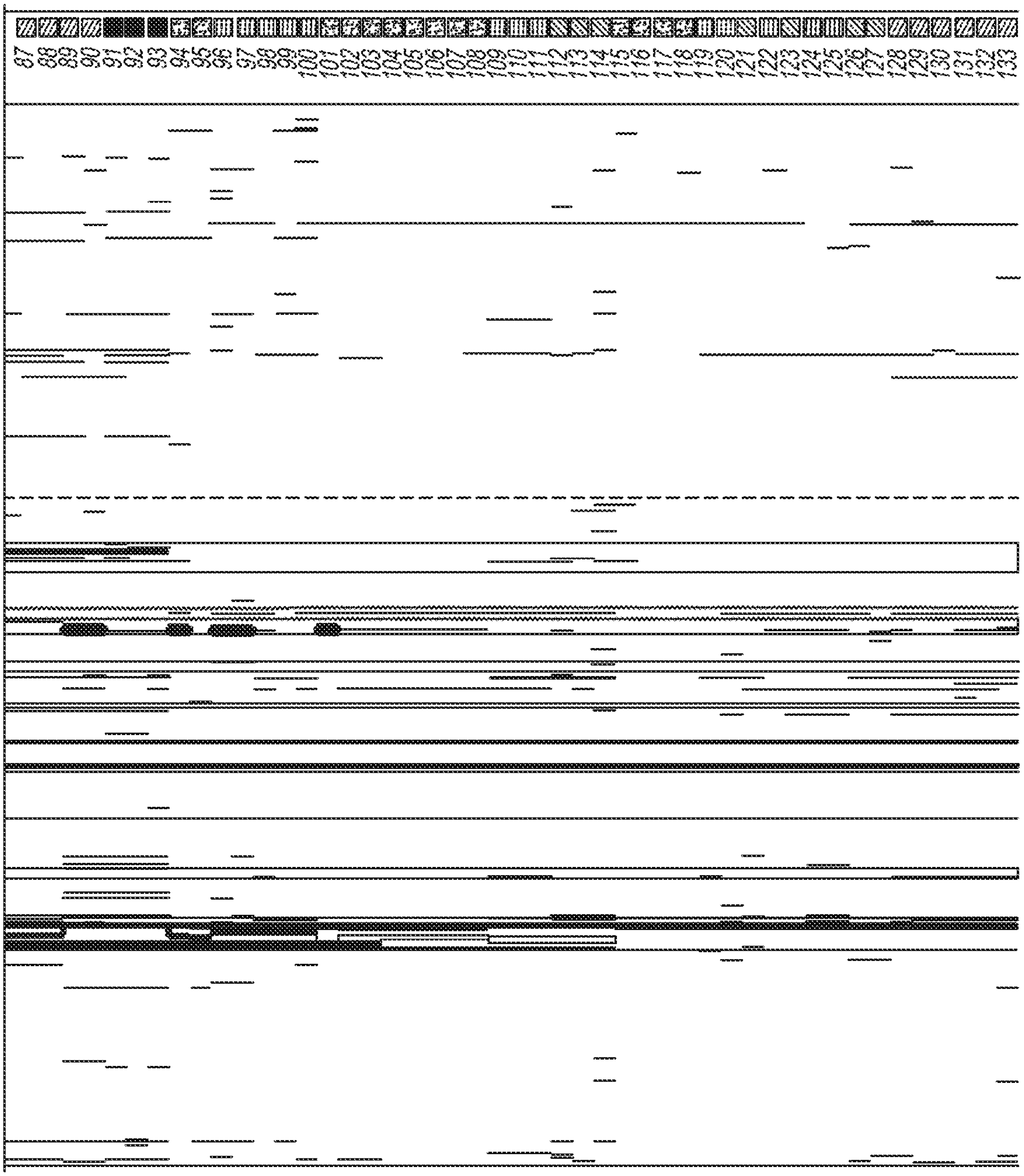
Figure 3A:
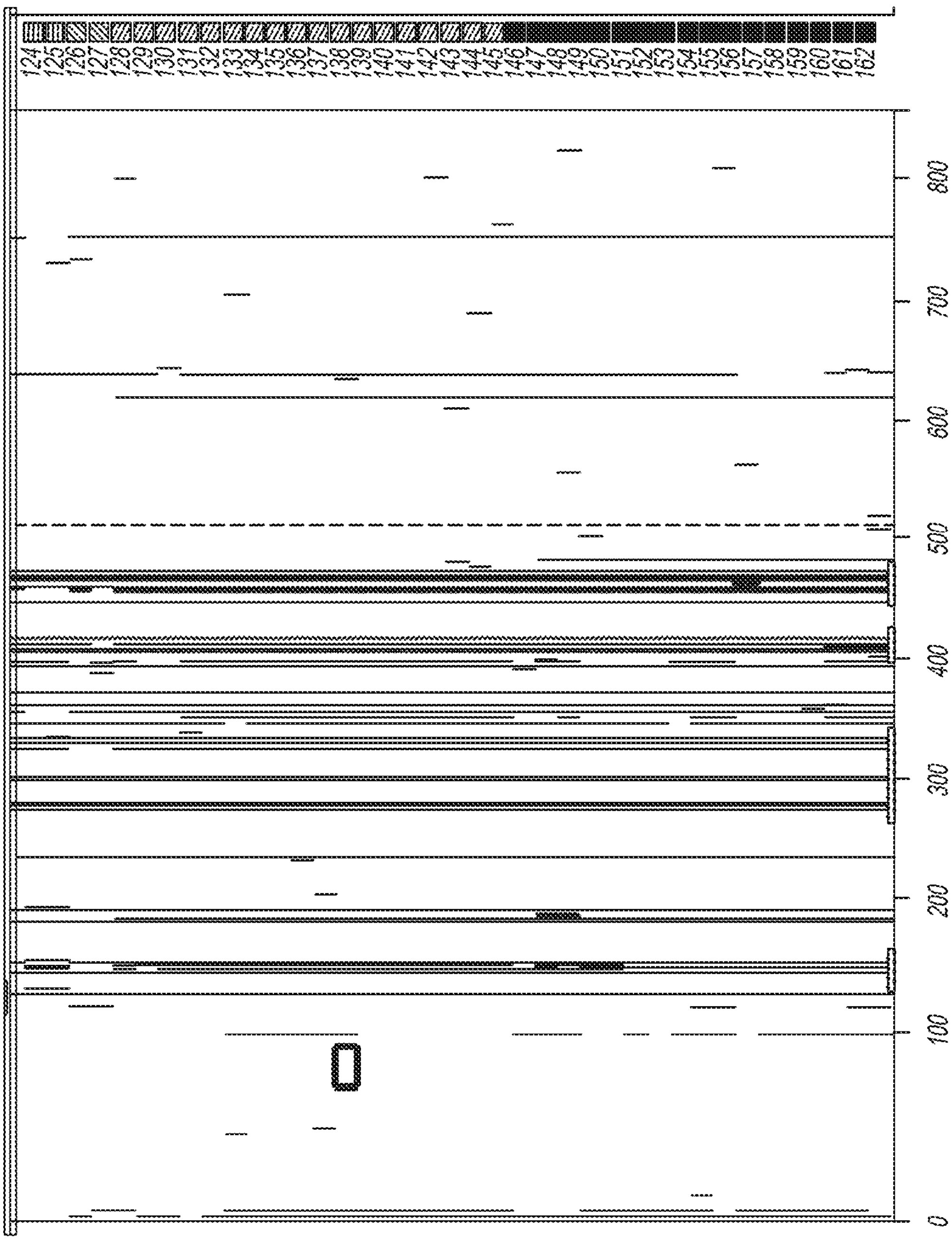
Figure 3B:
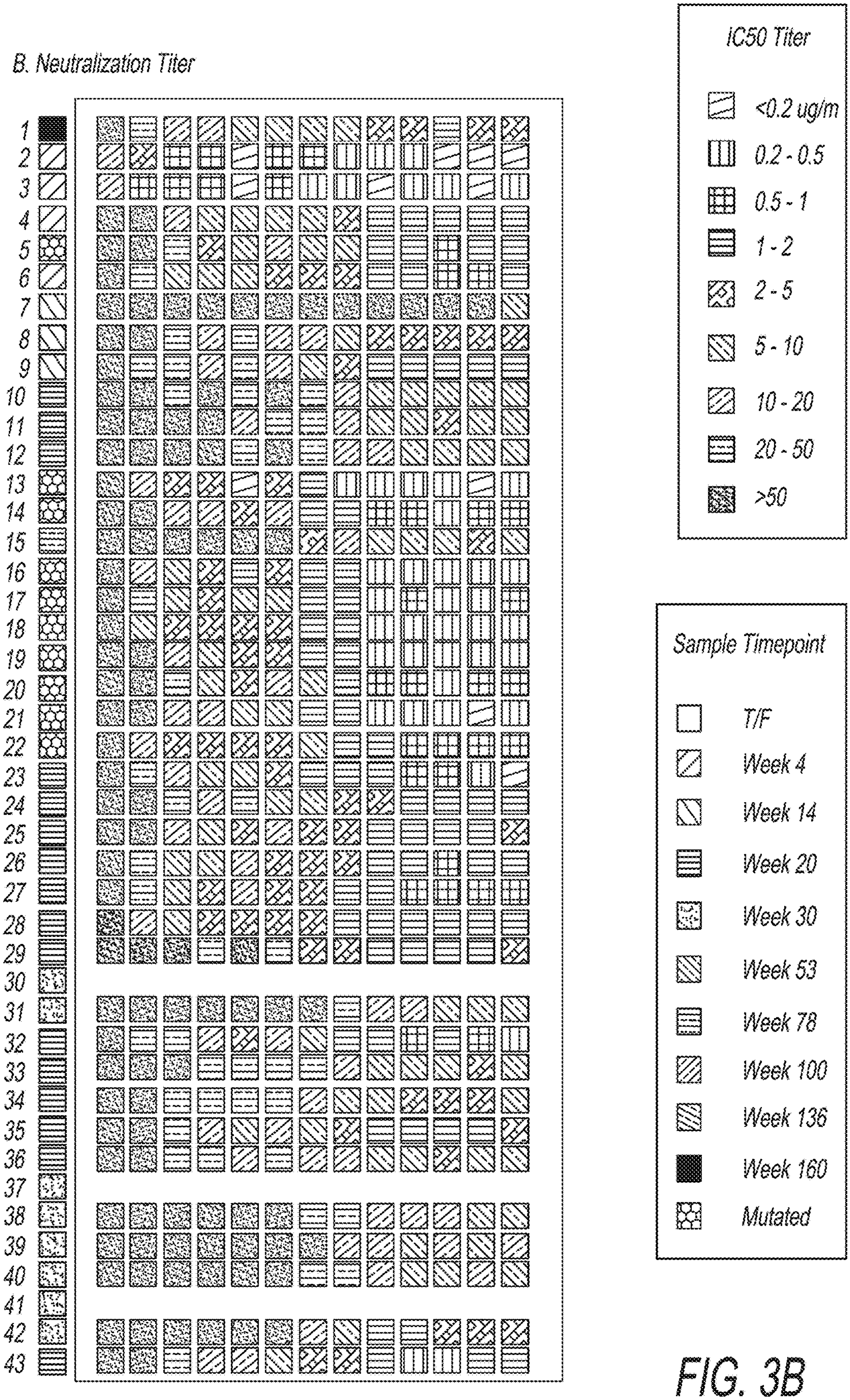
Figure 3B:
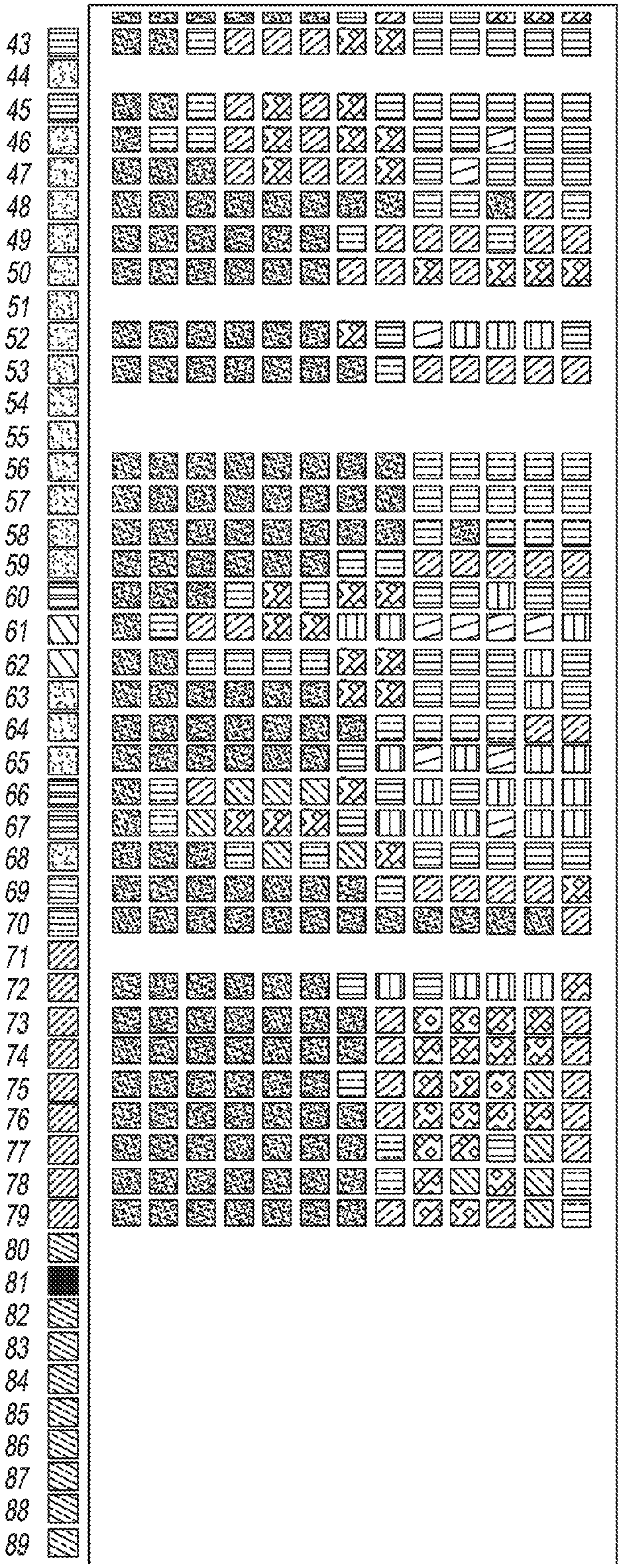
Figure 3B:
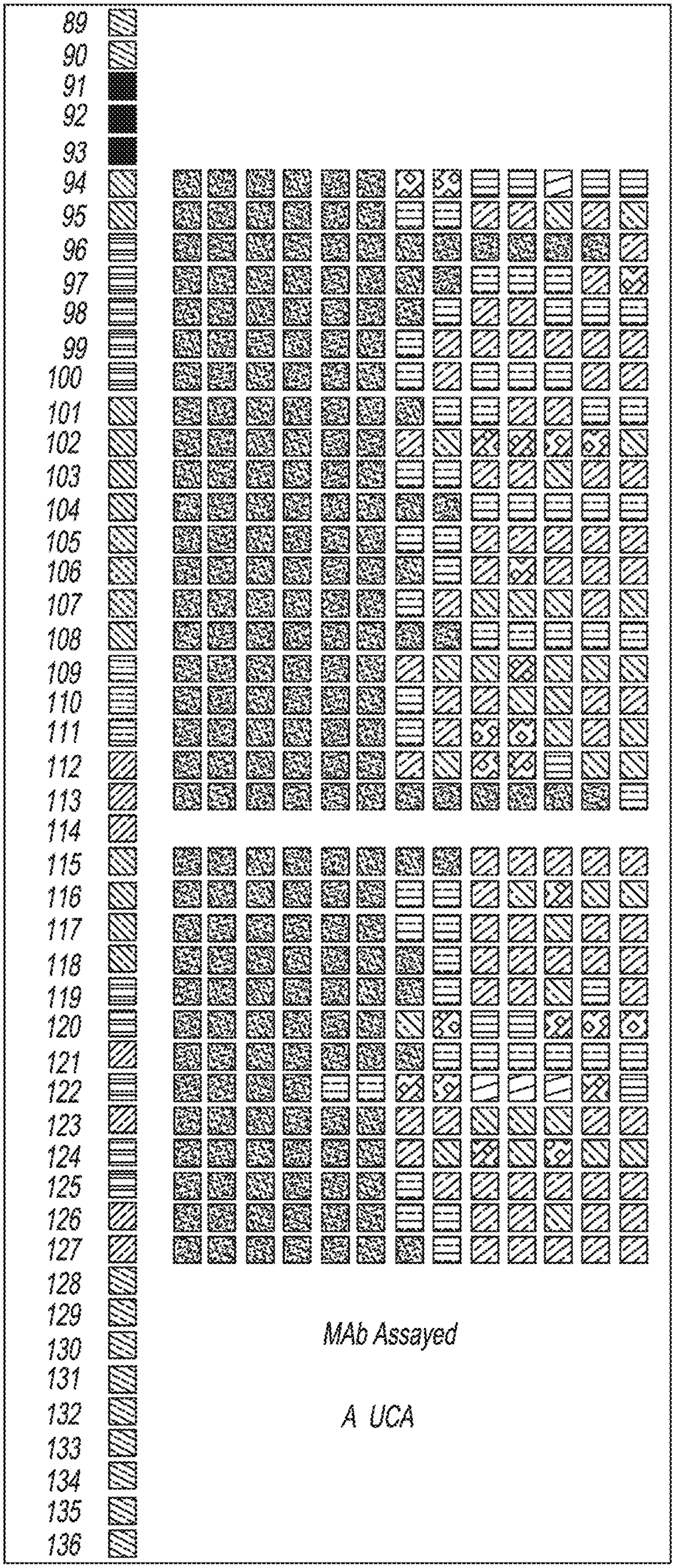
Figure 3B:
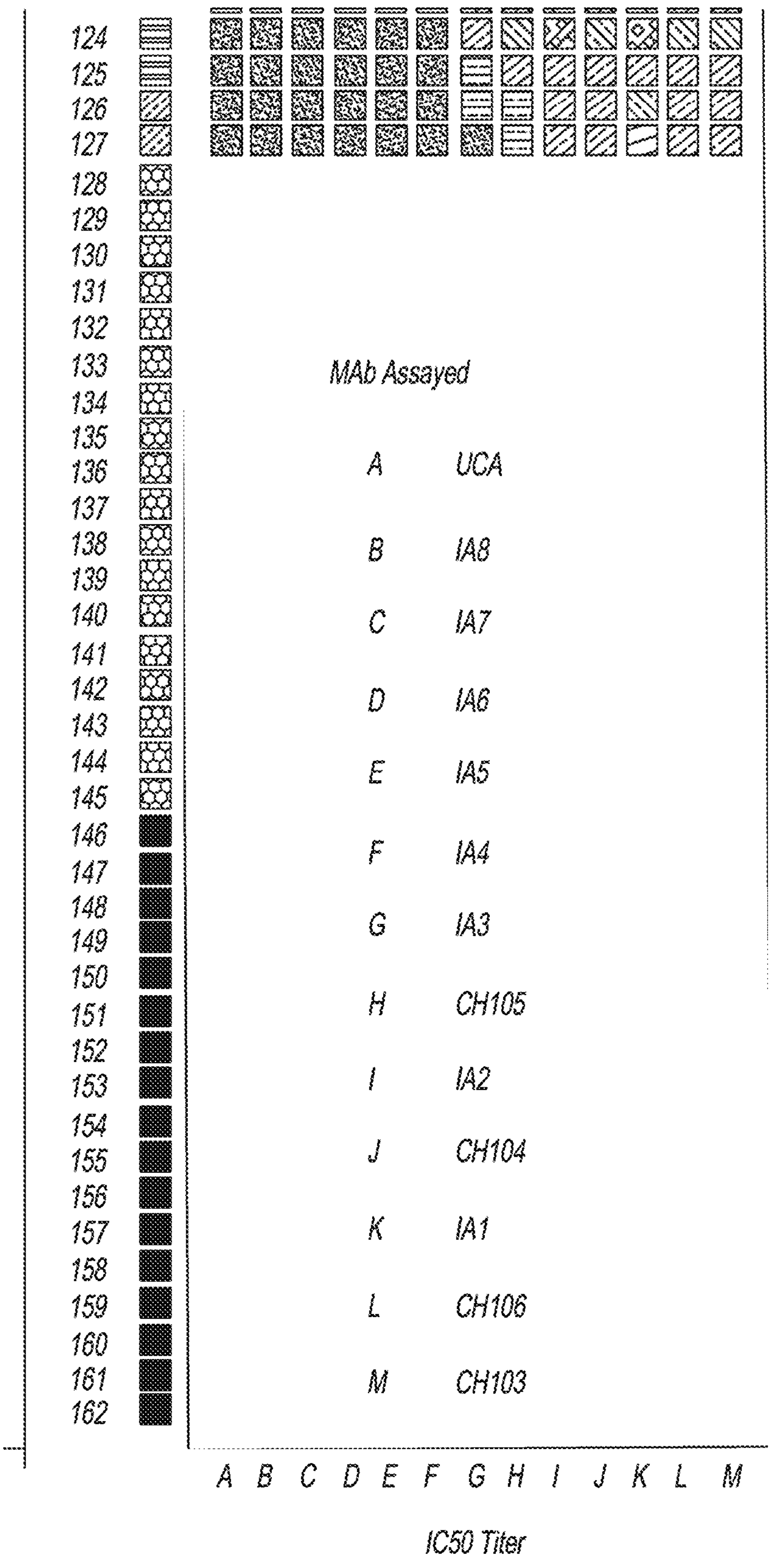
Figure 3C:
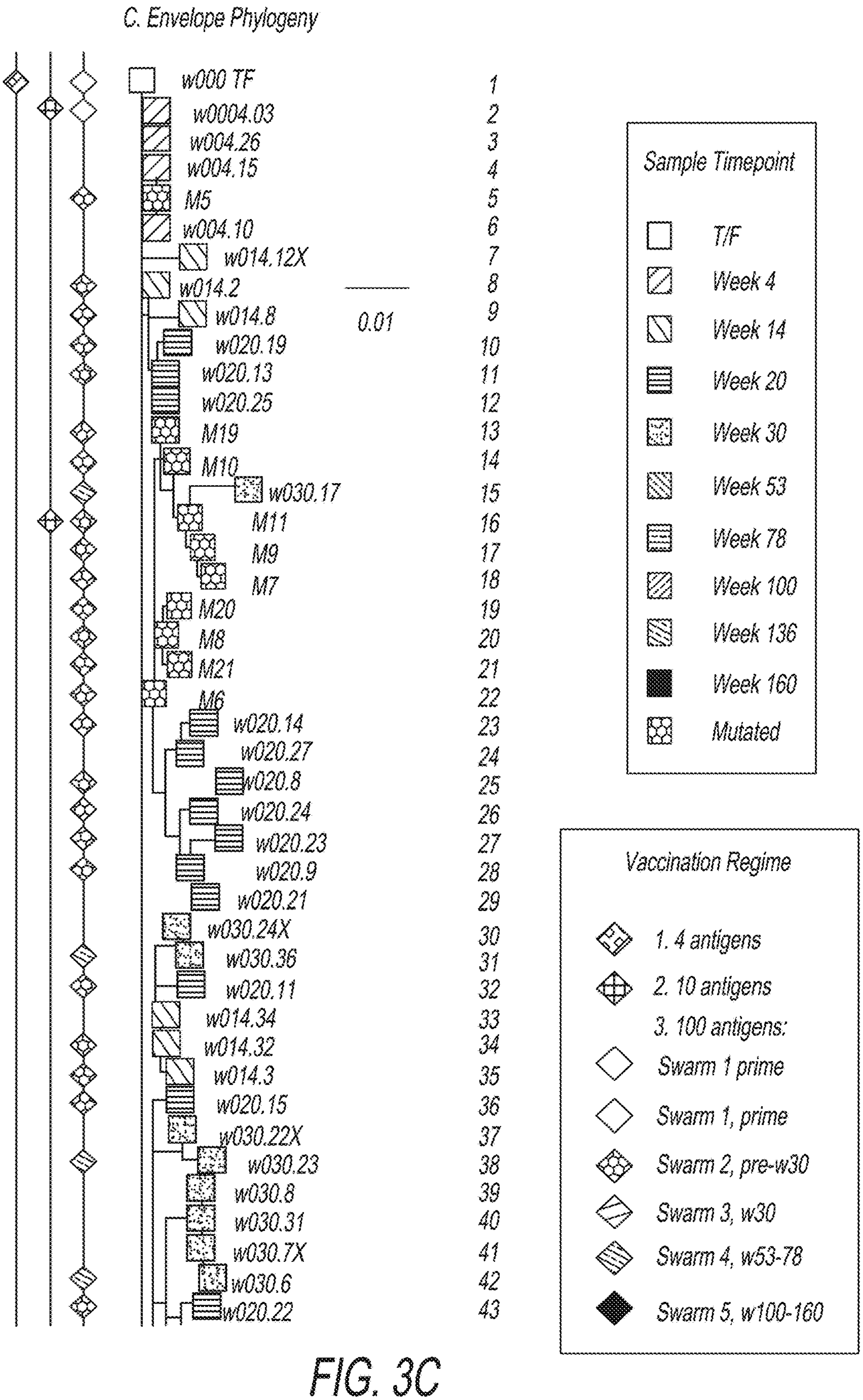
Figure 3C:
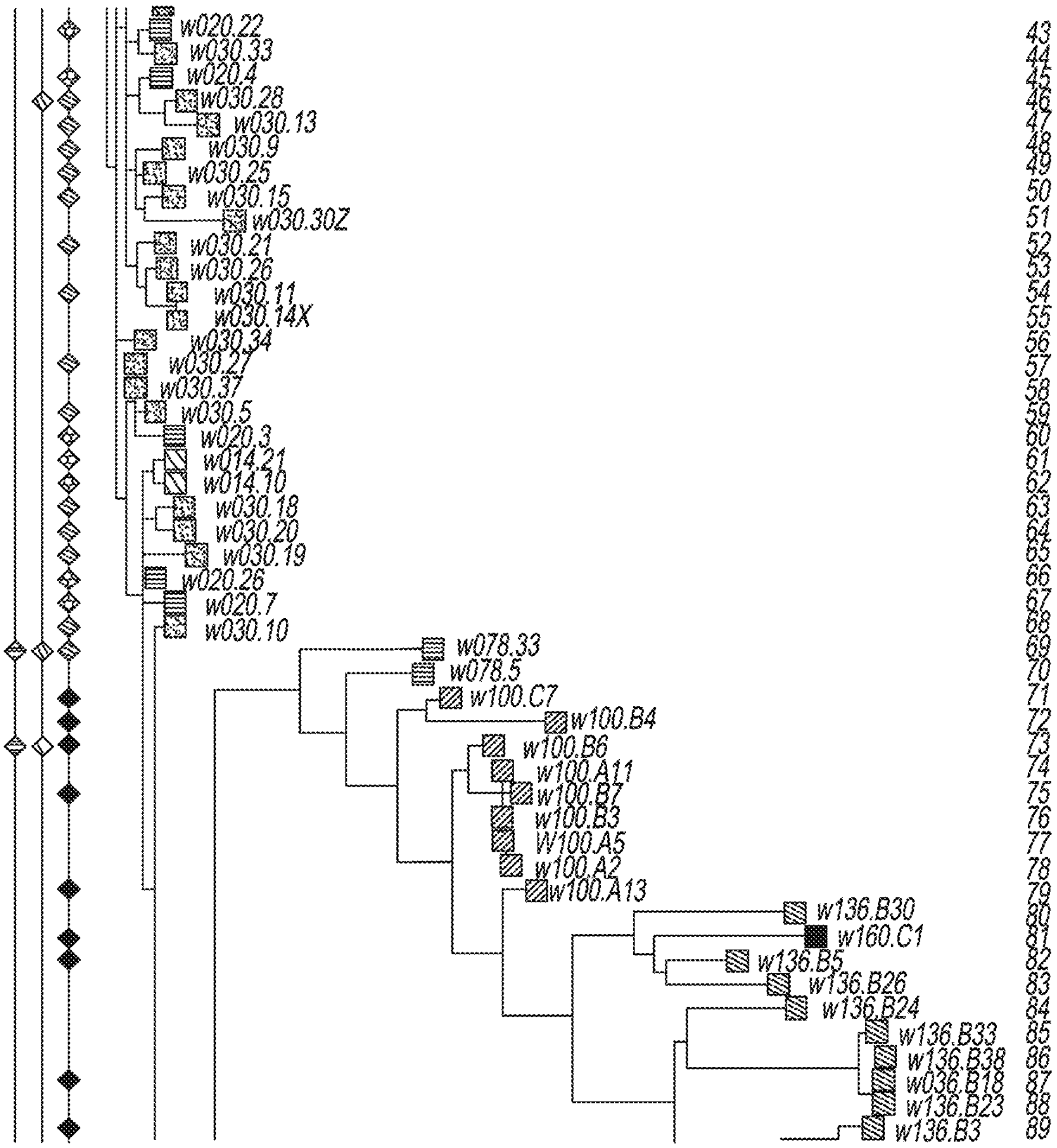
Figure 3C:
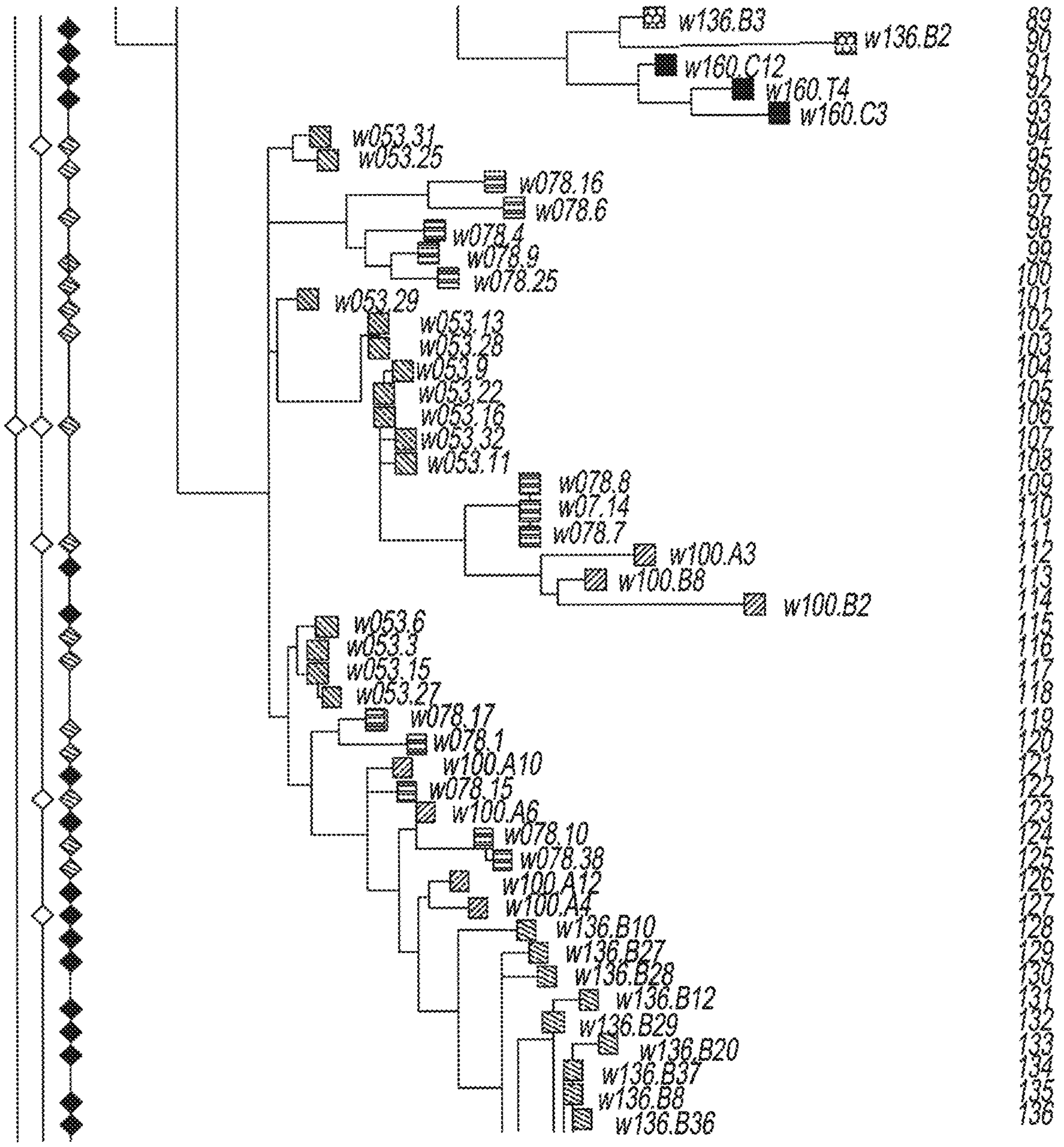
Figure 3C:
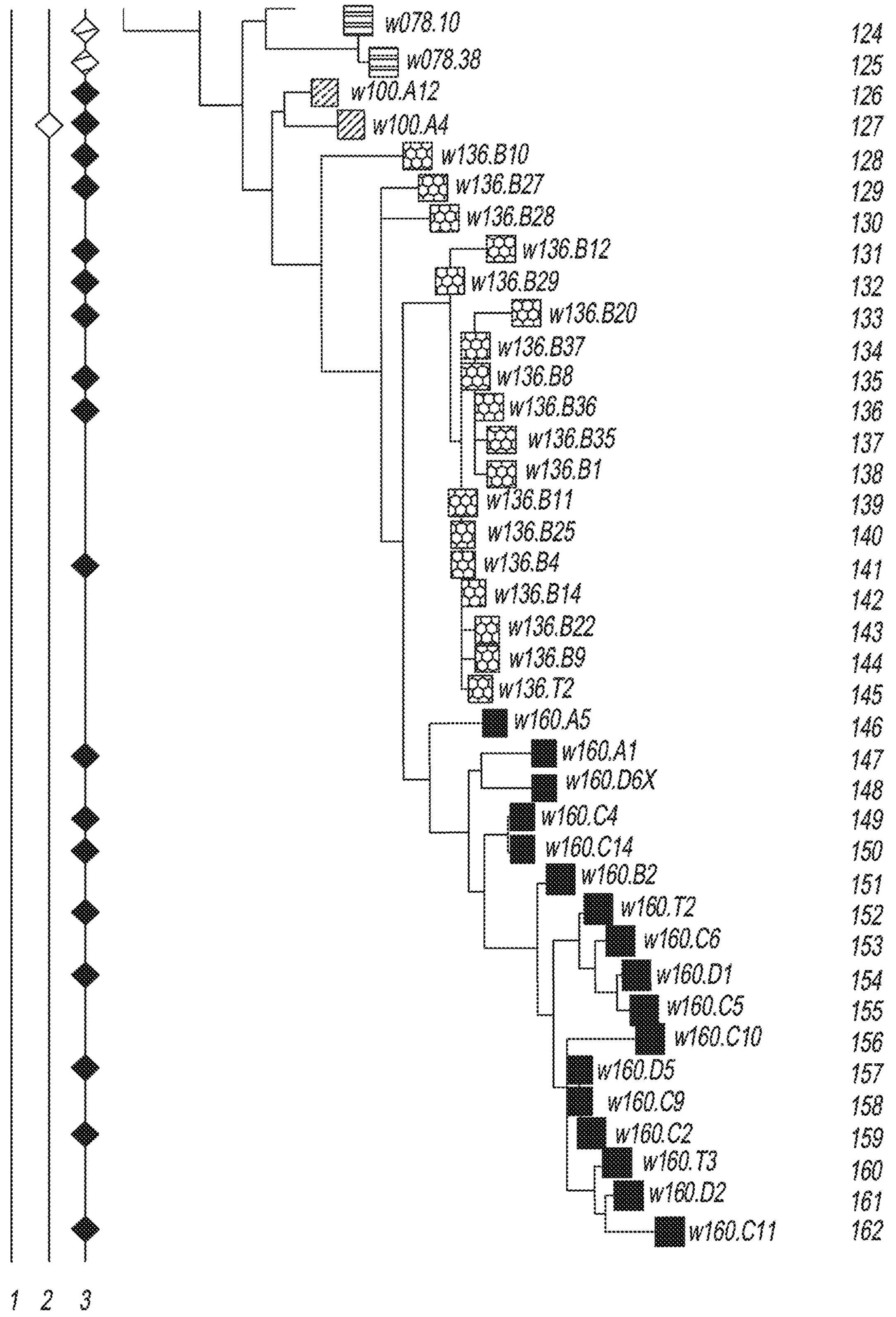
Figure 4:
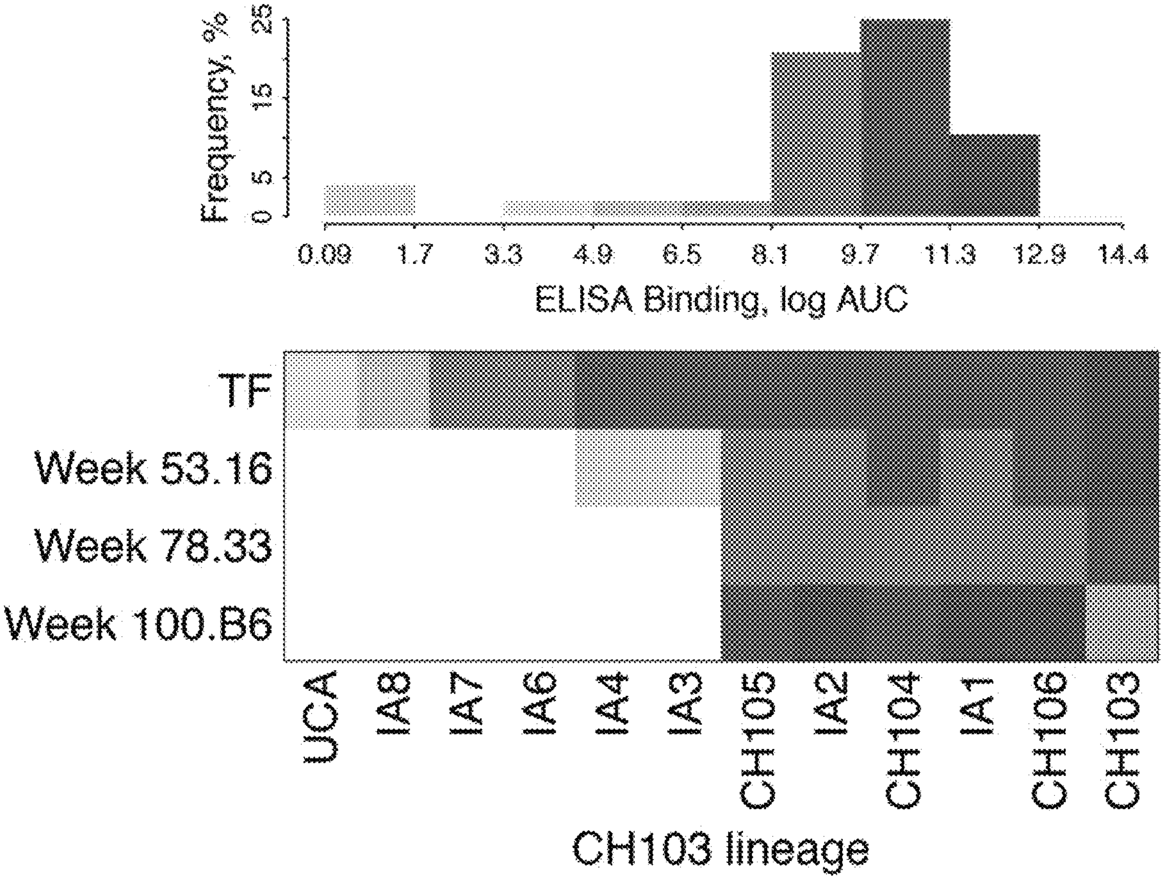
FIGS. 4-8 show Heat Map of Binding (log Area Under the Curve, AUC) of Sequential Envs to CH103 and CH235 CD4 Binding Site Broadly Neutralizing Antibody Lineages members. Numerical data corresponding to the graphic representations in these figures are shown in Tables 2-5 in Example 2.
Figure 5:
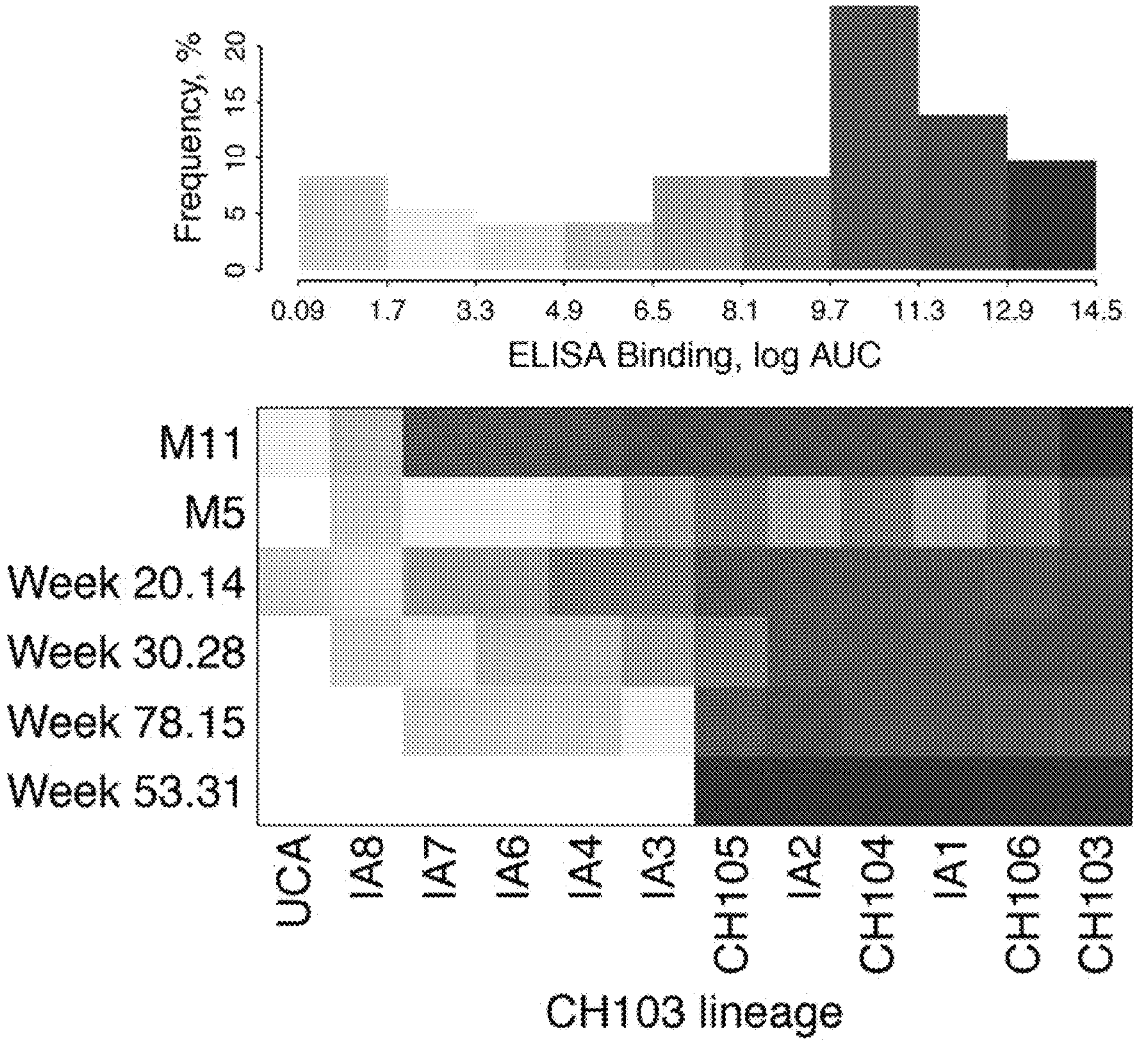
Figure 6:
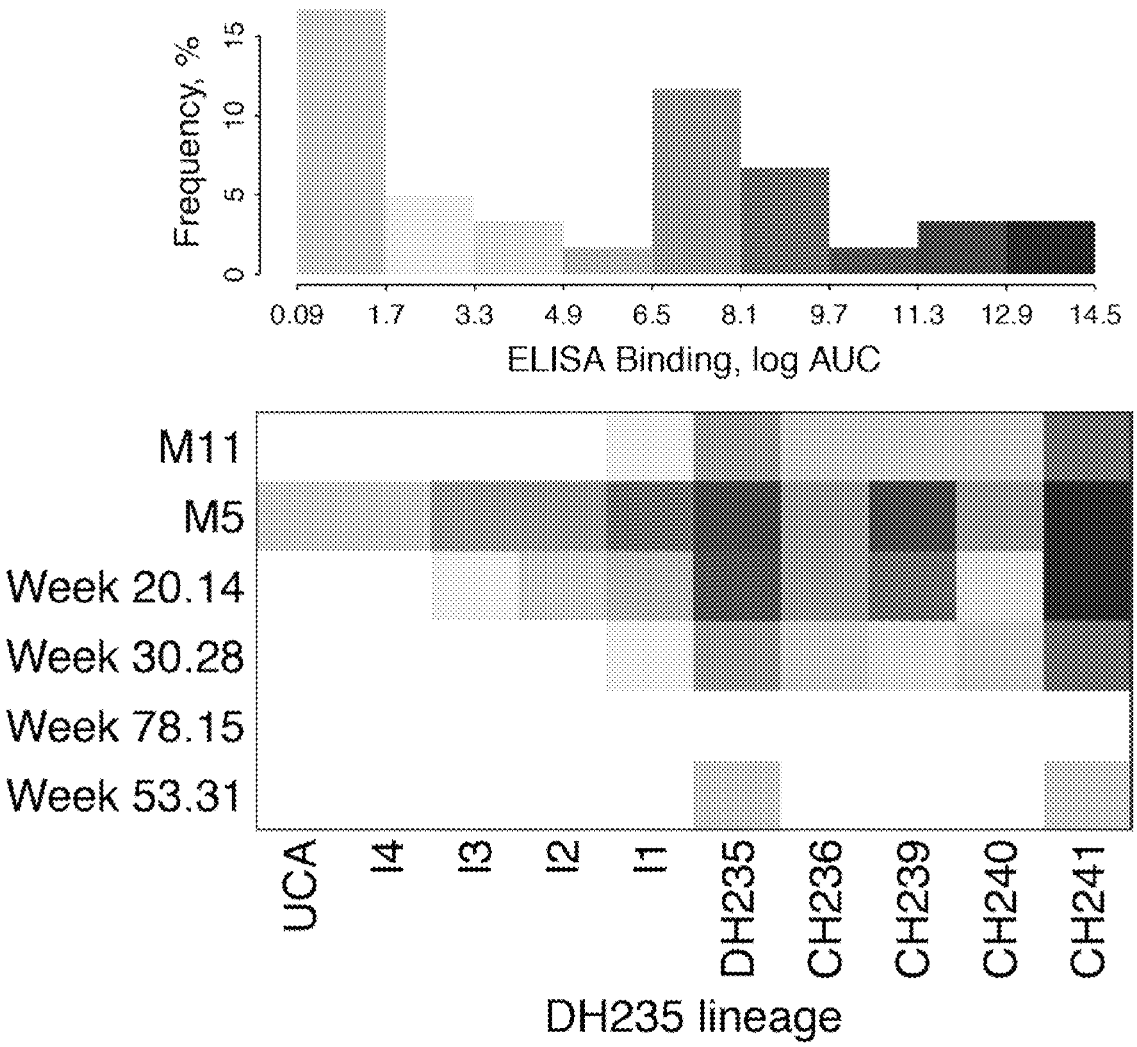
Figure 7:
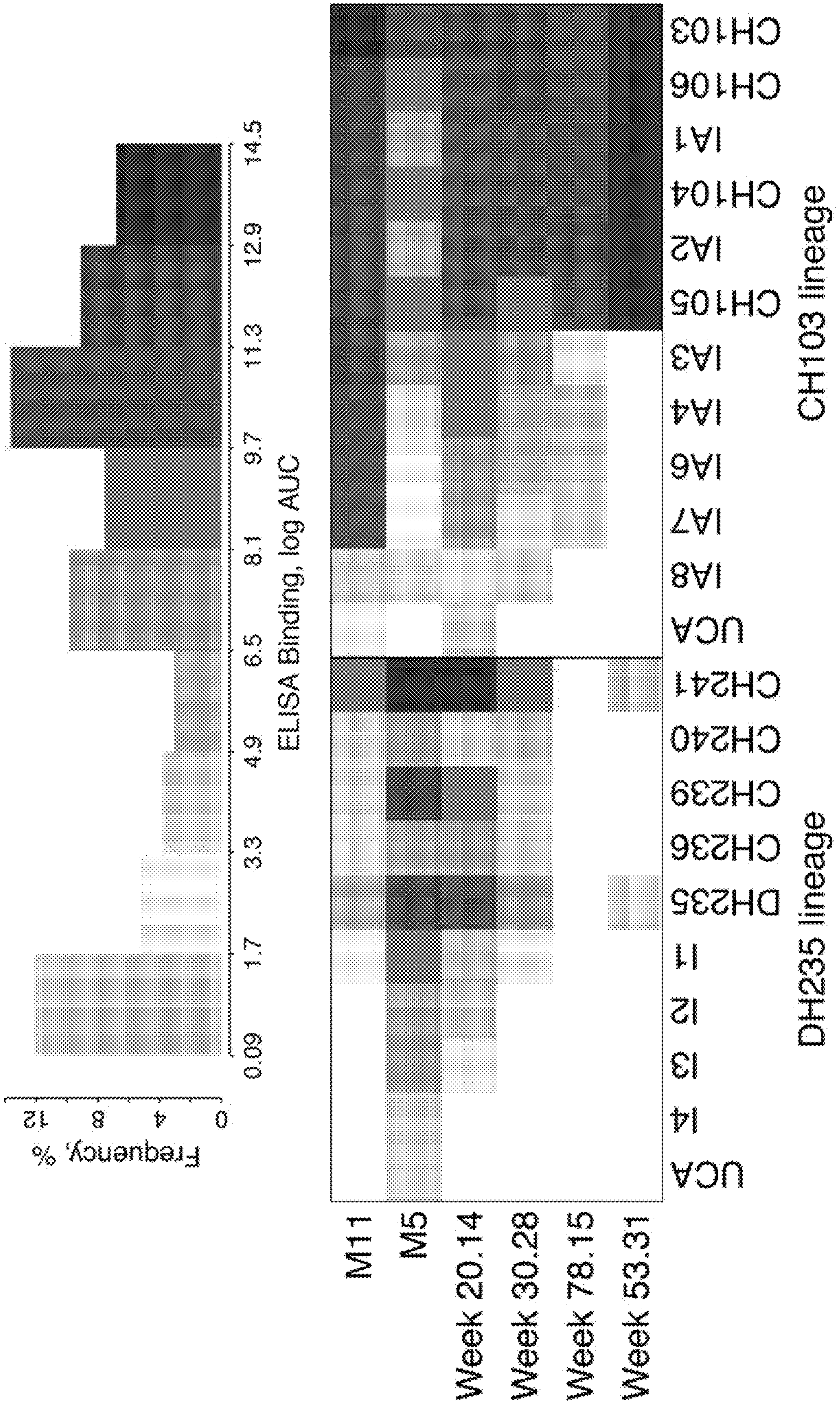
Figure 8:
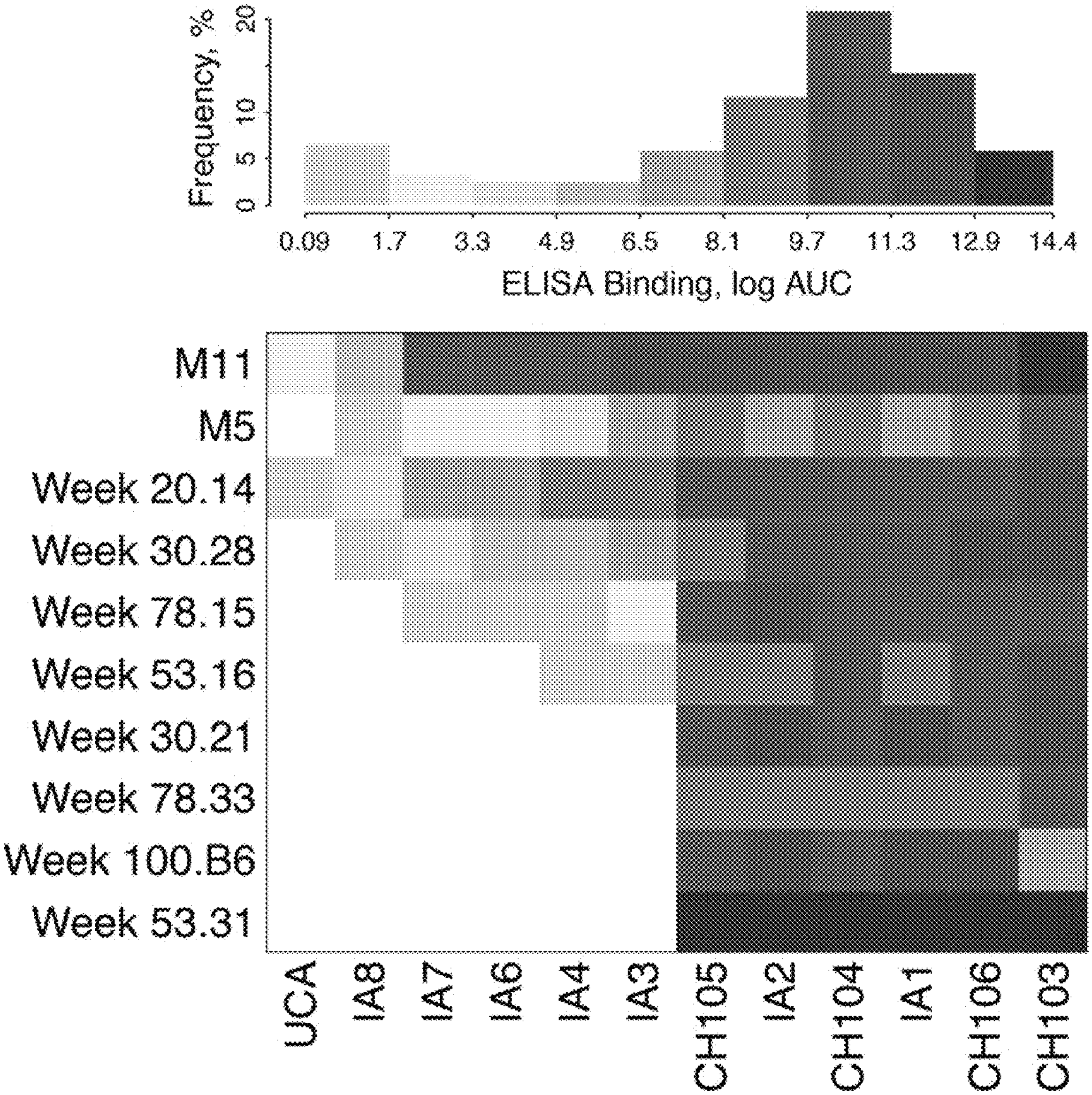
Figure 11:
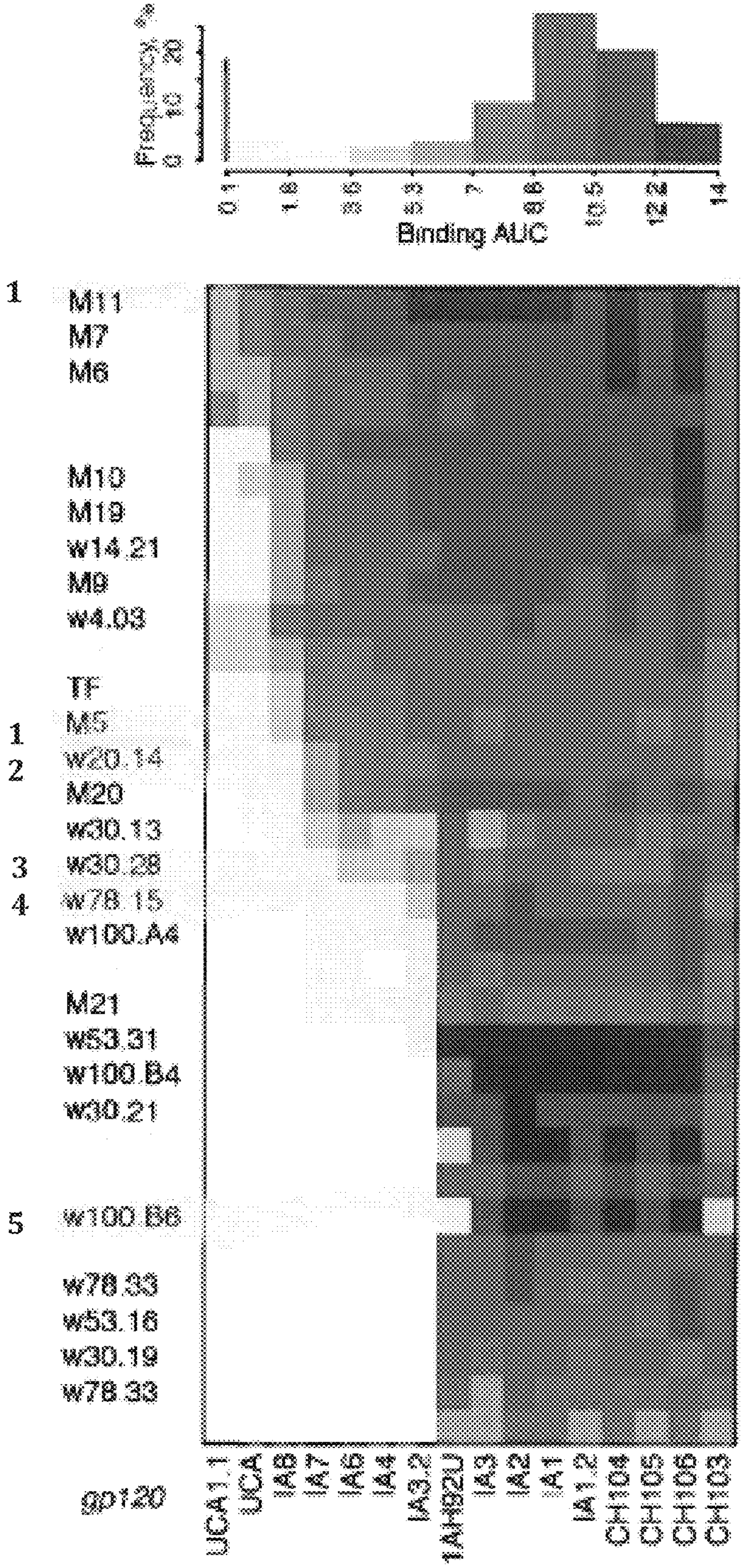
FIG. 11 shows CH103 ELISA binding data and choice of immunogens.
Figure 11:
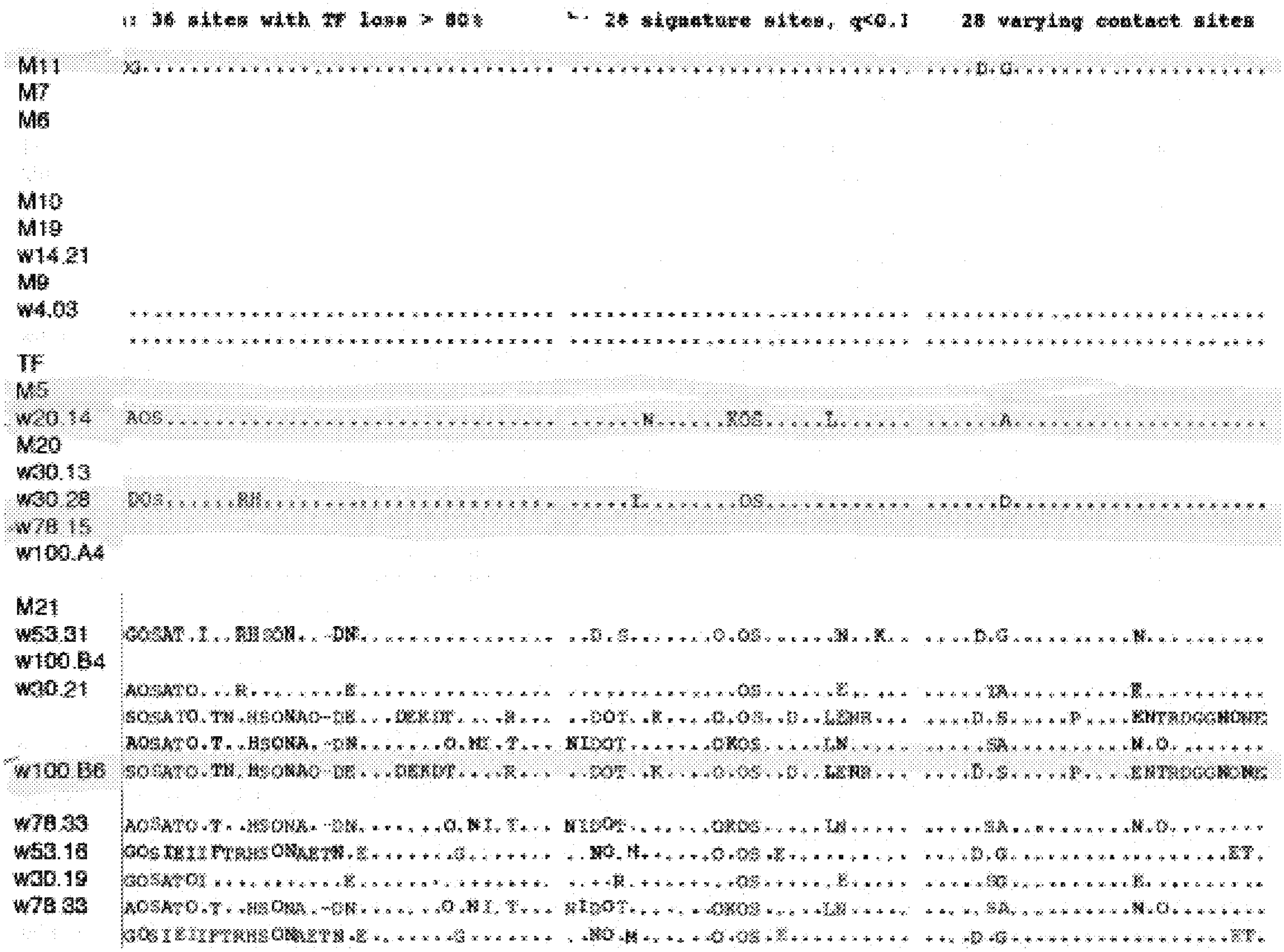
Figure 14A:
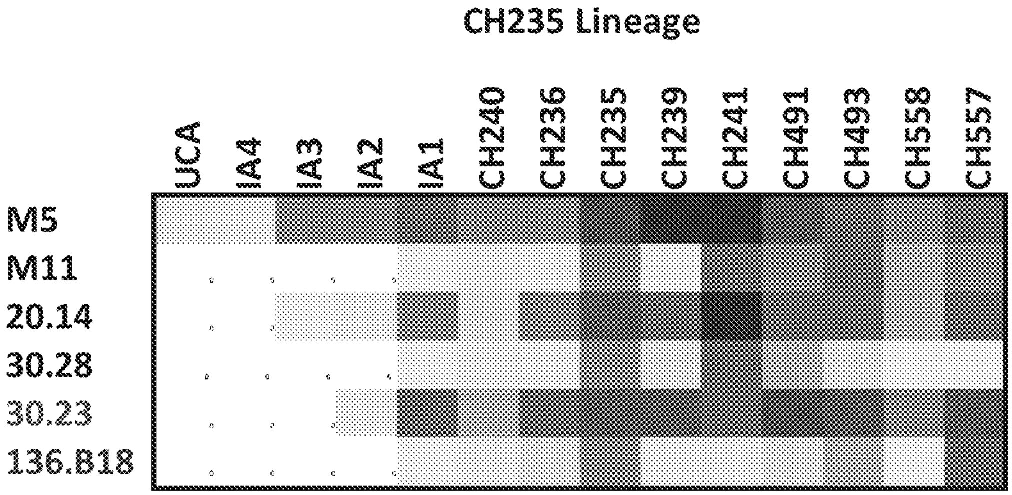
FIGS. 14A-B show a heat map of binding log Area Under the Curve, AUC) of Sequential Envs M5, M11, 20.14, 30.28, 30.23, 136.B18 to CH103 (FIG. 14B) and CH235 (FIG. 14A-includes lineage member CH557) CD4 Binding Site Broadly Neutralizing Antibody Lineages members.
Figure 14B:
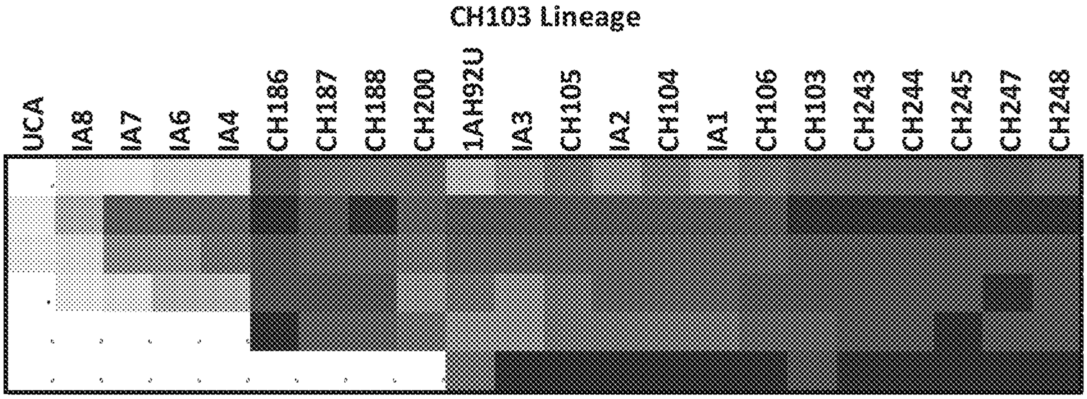
Figure 15A:
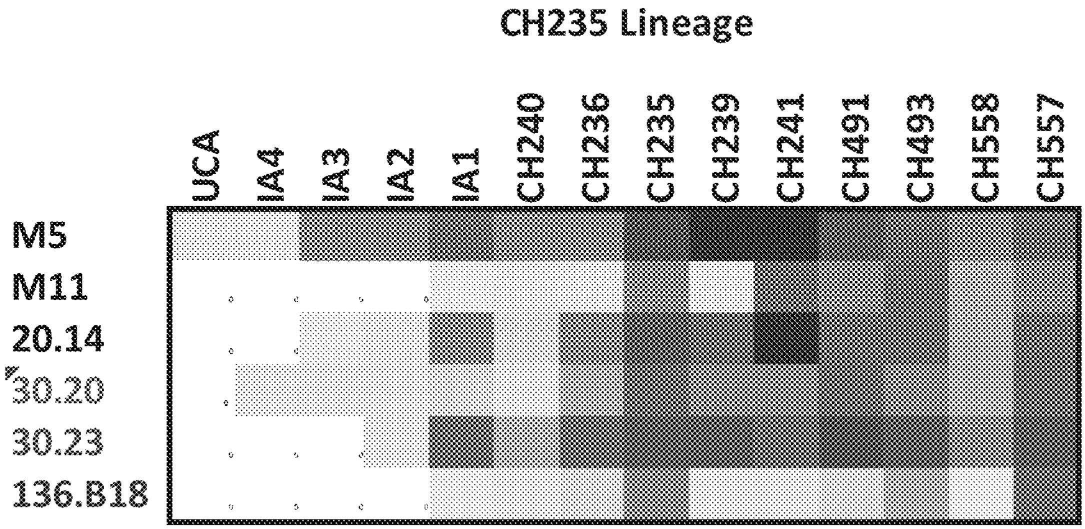
FIGS. 15A-B show a heat map of binding log Area Under the Curve, AUC) of Sequential Envs M5, M11, 20.14, 30.20, 30.23, 136.B18 to CH103 (FIG. 15B) and CH235 (FIG. 15A-includes lineage member CH557) CD4 Binding Site Broadly Neutralizing Antibody Lineages members. Env 30.20 has better progression for CH235 whereas 30.28 has better progression for CH103, however early CH103 intermediates are covered well by 20.14.
Figure 15B:
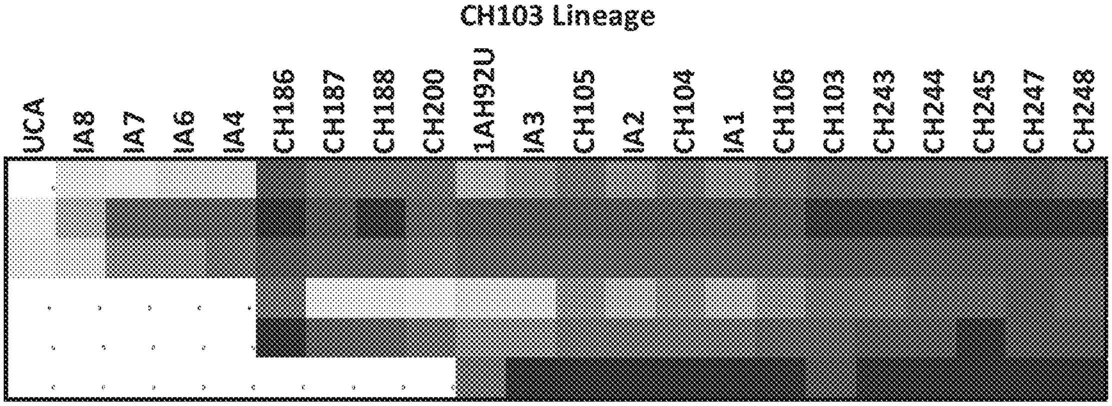
Figures 18A, 18B:
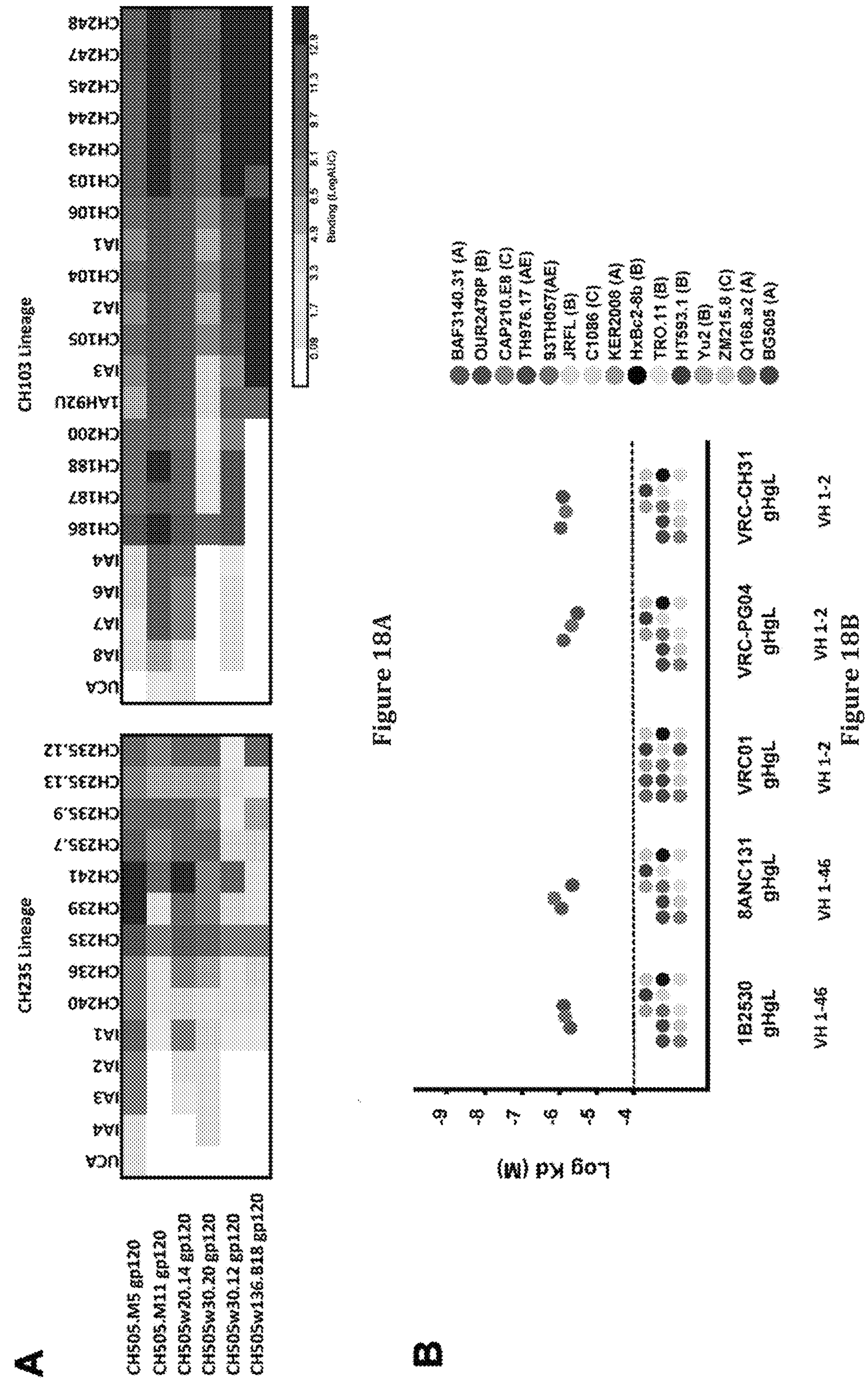

FIGS. 18A-B (see also FIGS. 52A-B from Example 8) show. CH505 gp120 Env Quasi-species Selected as Optimized Immunogens to Induce Both CH235 and CH103-like bnAbs, related to FIGS. 46A-B (Ex. 8). (A) Heatmap of the binding data of selected CH235 and CH103 lineage members to the CH505 Env glycoproteins selected to be used as immunogens. Individual Env clone names and weeks of isolation are shown on the left. (A) shows a binding log Area Under the Curve, AUC) of Sequential Envs M5, M11, 20.14, 30.20, 30.12, 136.B18 to CH235 (left panel) and CH103 (right panel) CD4 Binding Site Broadly Neutralizing Antibody Lineages members. (B) Affinity of gHgL of 1B2530, 8ANC131, VRC01, VRC-PG04 and VRC-CH31 to a panel of 15 heterologous gp120 envelope glycoproteins.

FIGS. 19A-B show nucleic acid and amino acid sequences of M5, M11, 20.14, 30.20, 30.12, 136.B18 envelopes (SEQ ID NOS 169-194, respectively, in order of appearance). The highlighted portions indicate non-coding sequences—one stop codon at the end of each nucleotide sequences is not highlighted.

Figure 20:
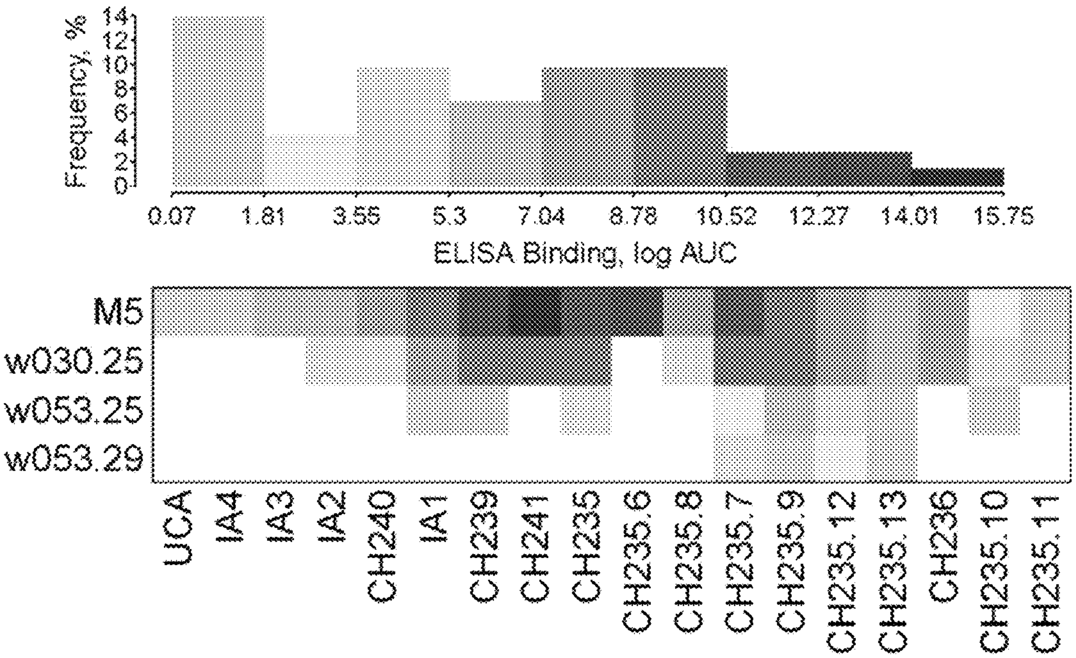

FIG. 20 shows a selection for a Sequential Vaccine. Heat Map of Binding (log Area Under the Curve, AUC) of Sequential Envs to CH235 VH1-46 type of CD4 mimic, CD4 Binding Site Broadly Neutralizing Antibody Lineage Members for sequential immunization. X axis shows CH235 antibody lineage members, from UCA to mature antibodies, from left to right.

Figure 21:
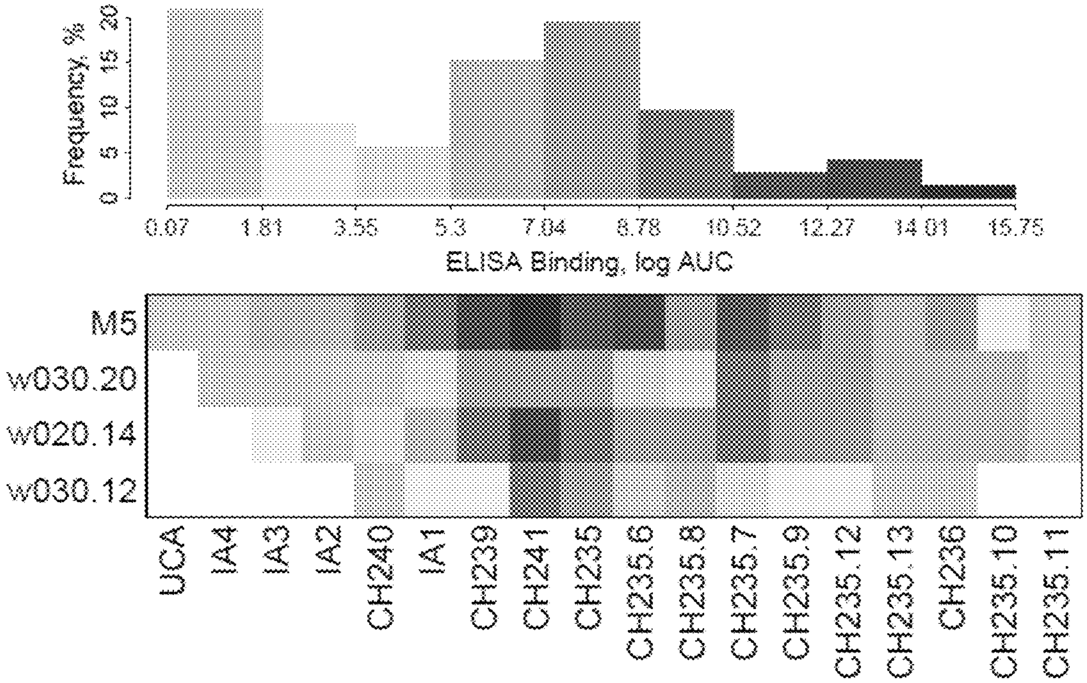

FIG. 21 shows a selection for a Sequential Vaccine. Heat Map of Binding (log Area Under the Curve, AUC) of Sequential Envs to CH235 VH1-46 type of CD4 mimic, CD4 Binding Site Broadly Neutralizing Antibody Lineage Members for sequential immunization.

FIG. 22A shows CH505 chimeric 6R.SOSIP.664 design. The gp120 of CH505 (right) except the c-terminal 37 amino acids was transplanted into the well-characterized A.BG505 6R.SOSIP.664 (left). The transplantation design takes advantage of the enhanced stability of the A.BG505 strain. The resultant chimeric molecule (center) has the CH505 gp120 (yellow) fused to the 37 c-terminal amino acids of A.BG505 (blue) and the A.BG505 gp41 (magenta).

FIG. 22B shows nucleic acid sequences of various trimer designs of FIG. 23A (SEQ ID NOS 195-233, respectively, in order of appearance).

FIG. 23A shows amino acid sequences of various trimer designs (SEQ ID NOS 234-272). In some embodiments the leader sequence for these proteins is MPMGSLQPLATLYLLGMLVASVLA (SEQ ID NO: 273).

FIG. 23B shows annotated sequence of SOSIP.III design (SEQ ID NOS 273-276, respectively, in order of appearance).

Figure 24C:
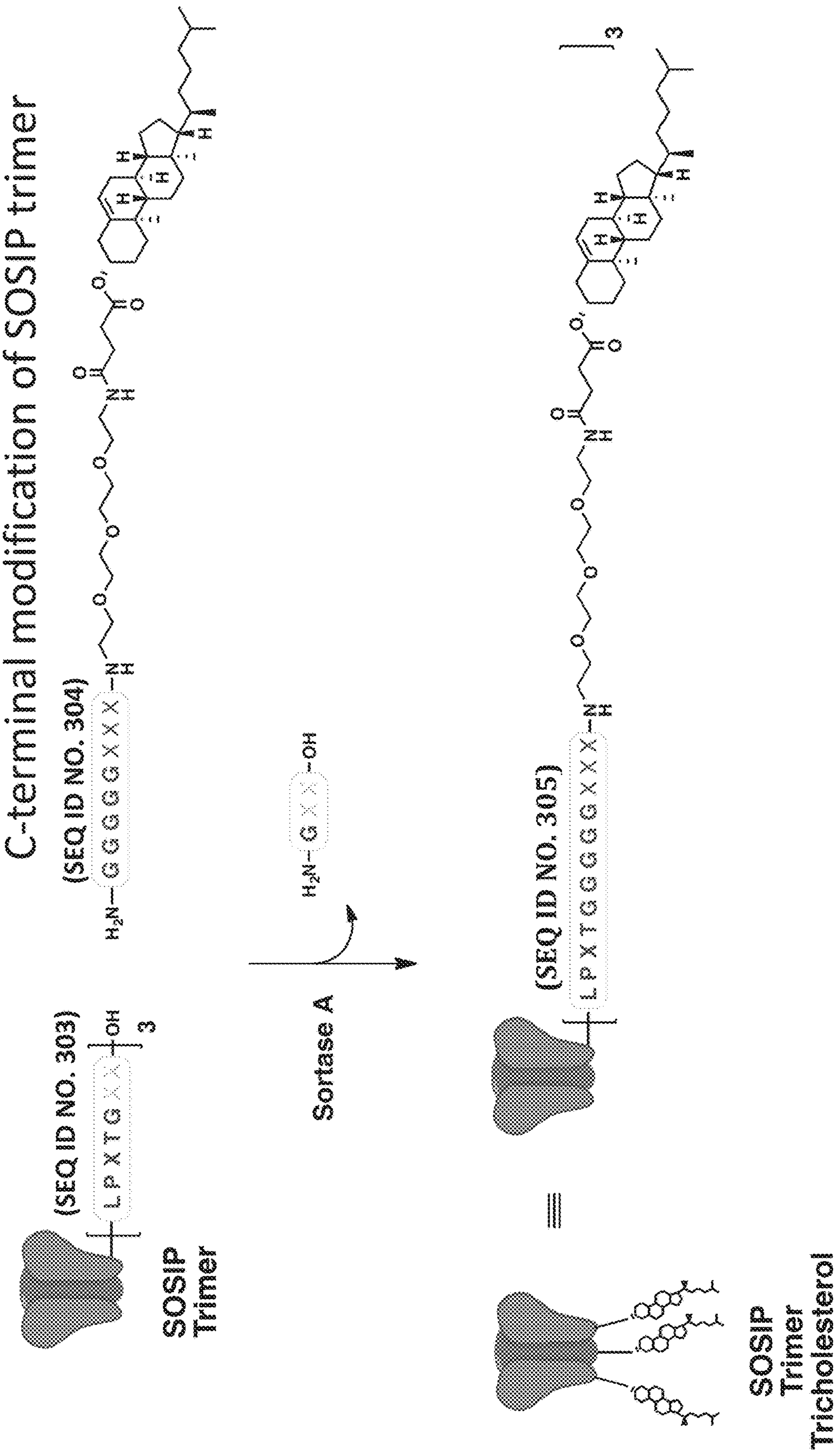
Figure 24D:
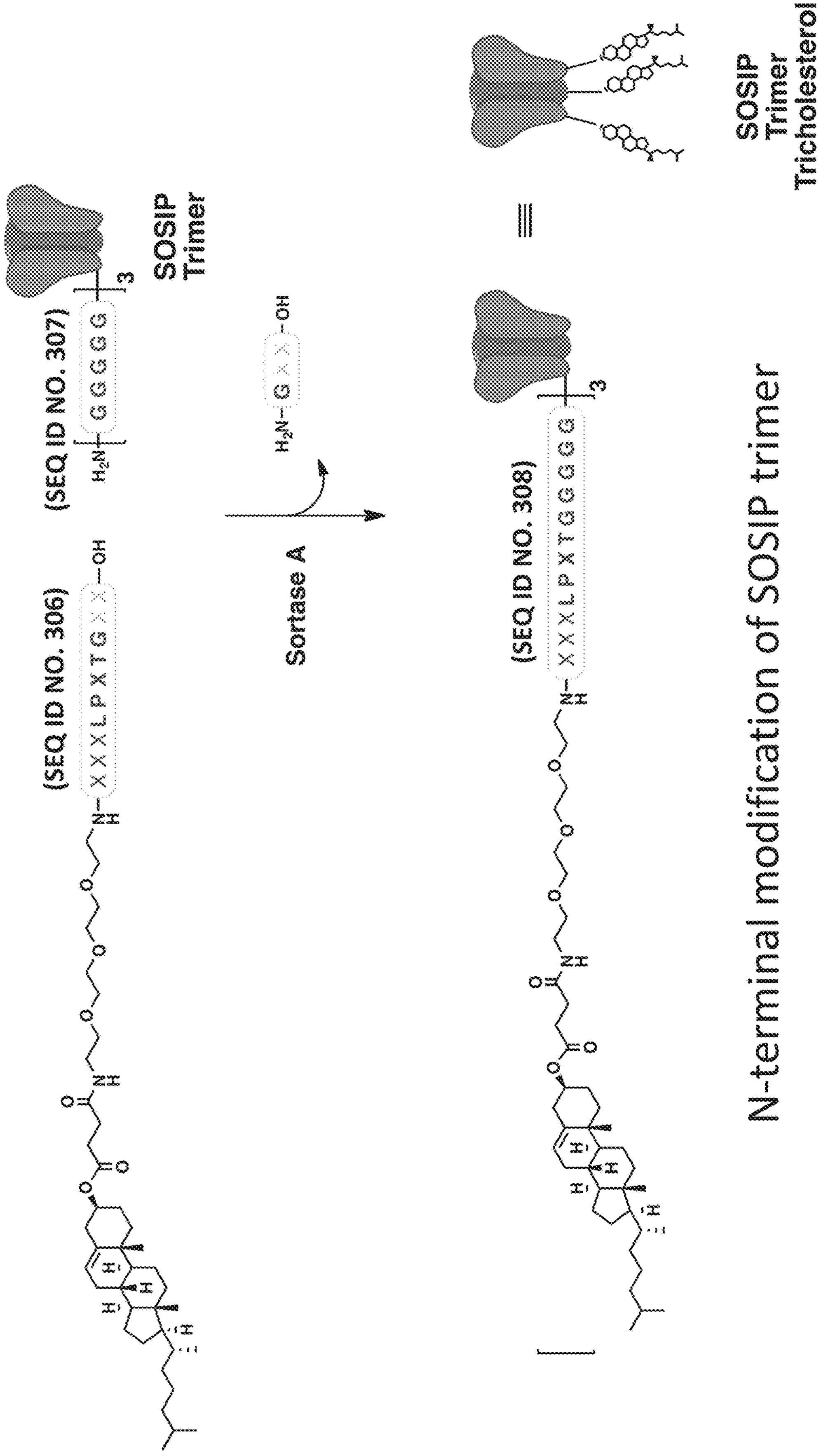

FIG. 24A shows amino acid and nucleic acid sequences of designs CH505TF.6R.SOSIP.664.v4.1_AMBRCTA and AMBRCTAG, and designs CH505M5chim.6R.SOSIP.664v4.1_AMBRCTA and AMBRCTAG (SEQ ID NOS 277-288, 290, 289, 292, 291, 294, 293, 295 and 296, respectively, in order of appearance). See also Example 9.

FIGS. 24B, C and D show sortase designs and nucleic acid and protein sequences (SEQ ID NOS 297-308, respectively, in order of appearance).

Figure 24E:
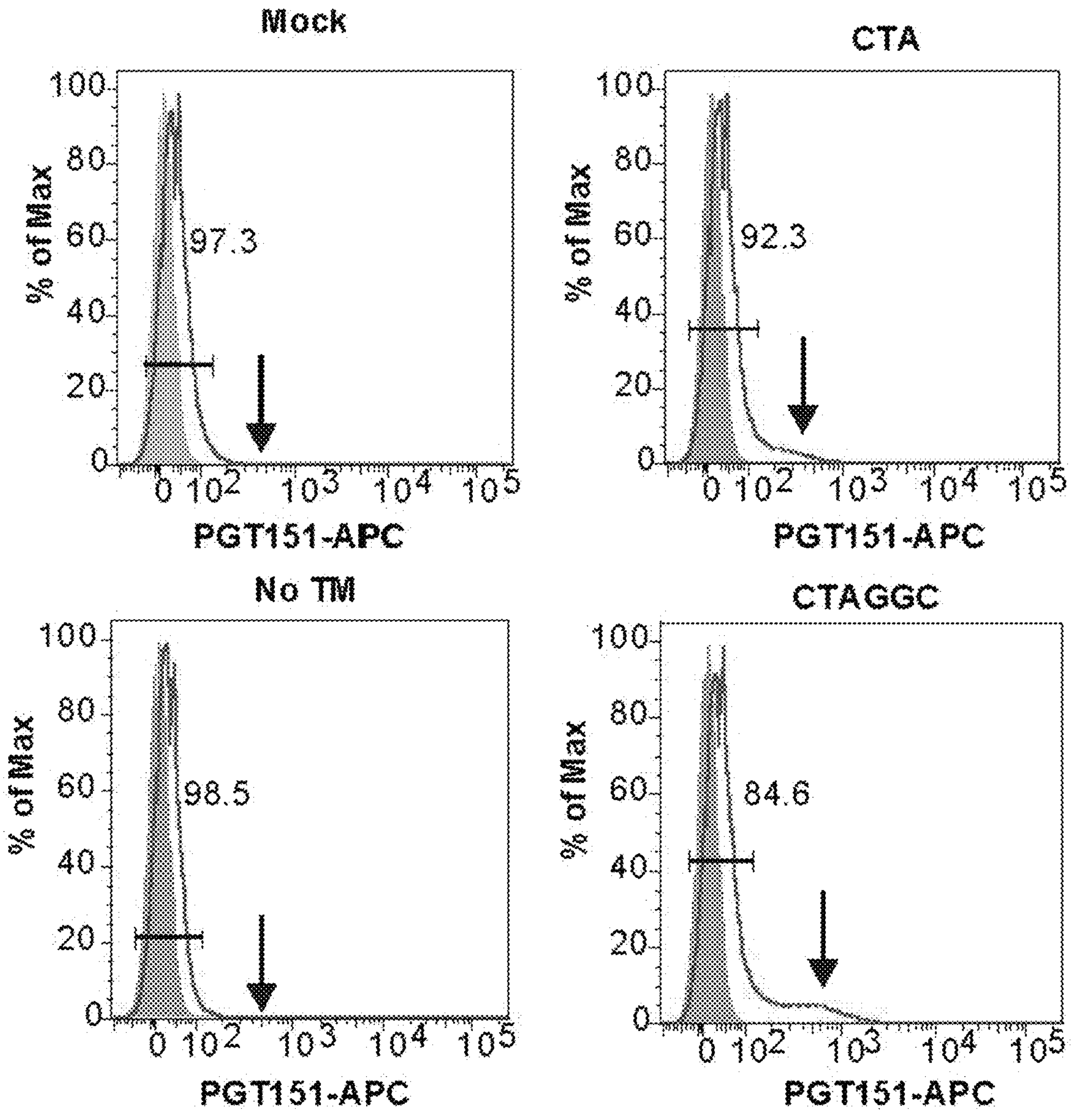

FIG. 24E shows the PGT151 antibody staining of 293F cells transiently transfected with AMBRCTA and AMBRCTAG constructs of FIG. 24A. Only the TM constructs show surface expression of Trimeric Envelope.

Figure 24F:
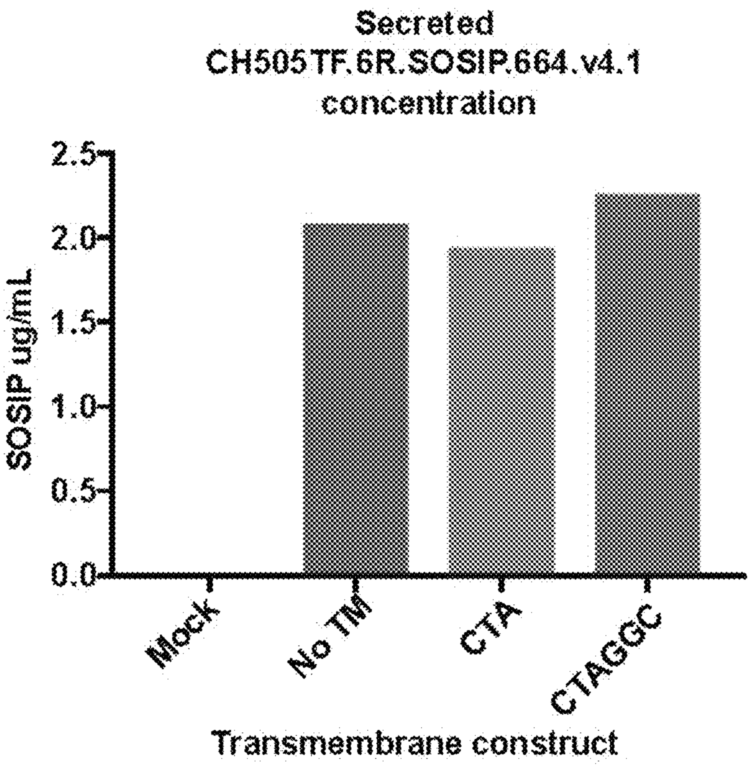

FIG. 24F shows the quantification of SOSIP trimer in the supernatant of cells transfected with the constructs of FIG. 24A FIG. 24G shows ferritin designs (SEQ ID NOS 309-313, respectively, in order of appearance).

Figure 24H:
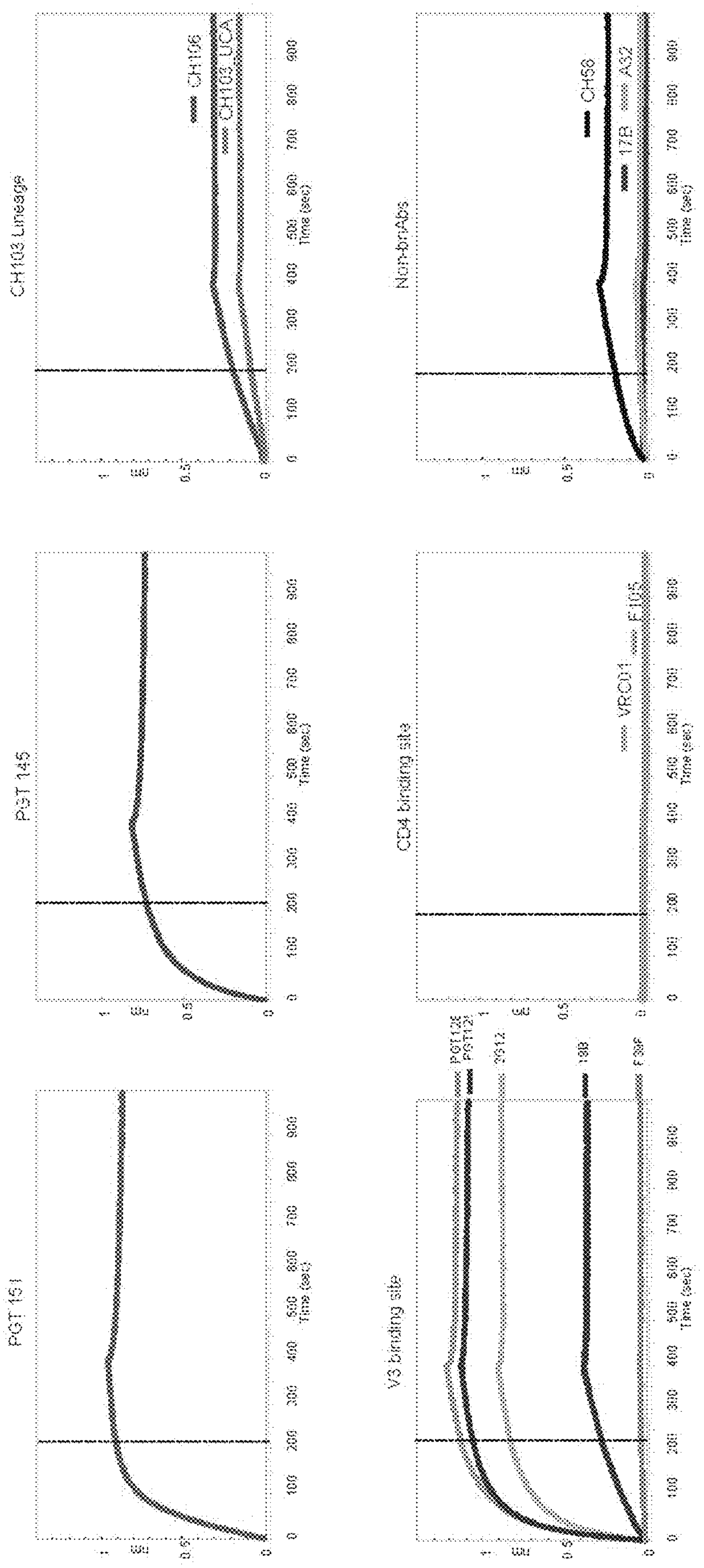

FIG. 24H shows antigenicity of M5 SOSIPv4.1 ferritin particle.

Figure 24I:
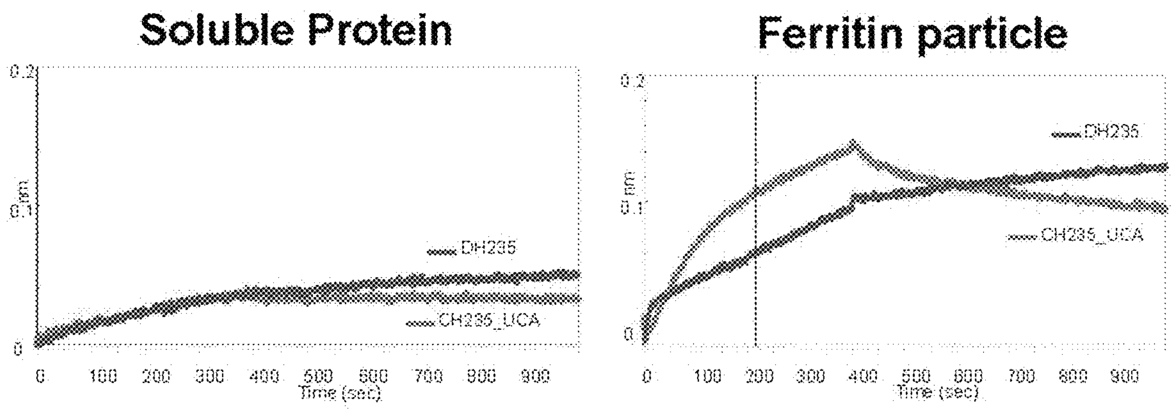

FIG. 24I shows comparison of binding of the M5 trimer alone versus the M5 trimer multimerized on the ferritin particle.

Figure 24J:
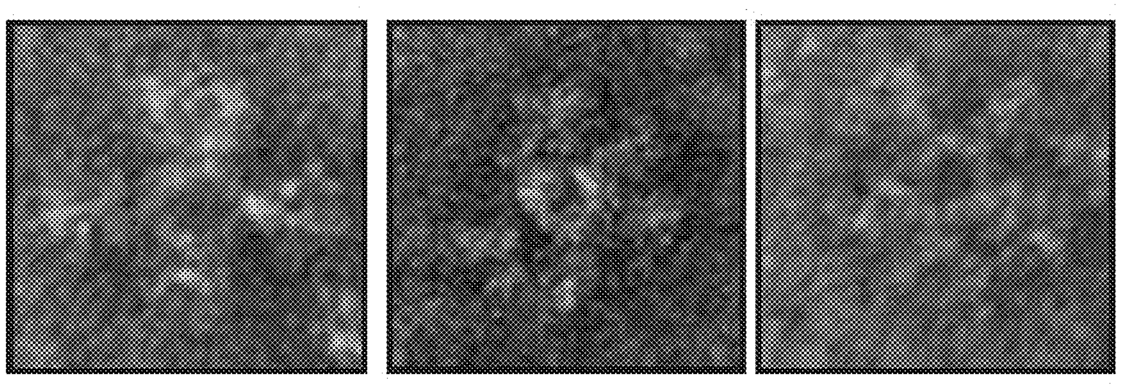

FIG. 24J shows negative stain EM of M5 trimers on the ferritin particle. The ring in the middle is ferritin and the trimer is the spikes coming off of the ring.

Figure 25:
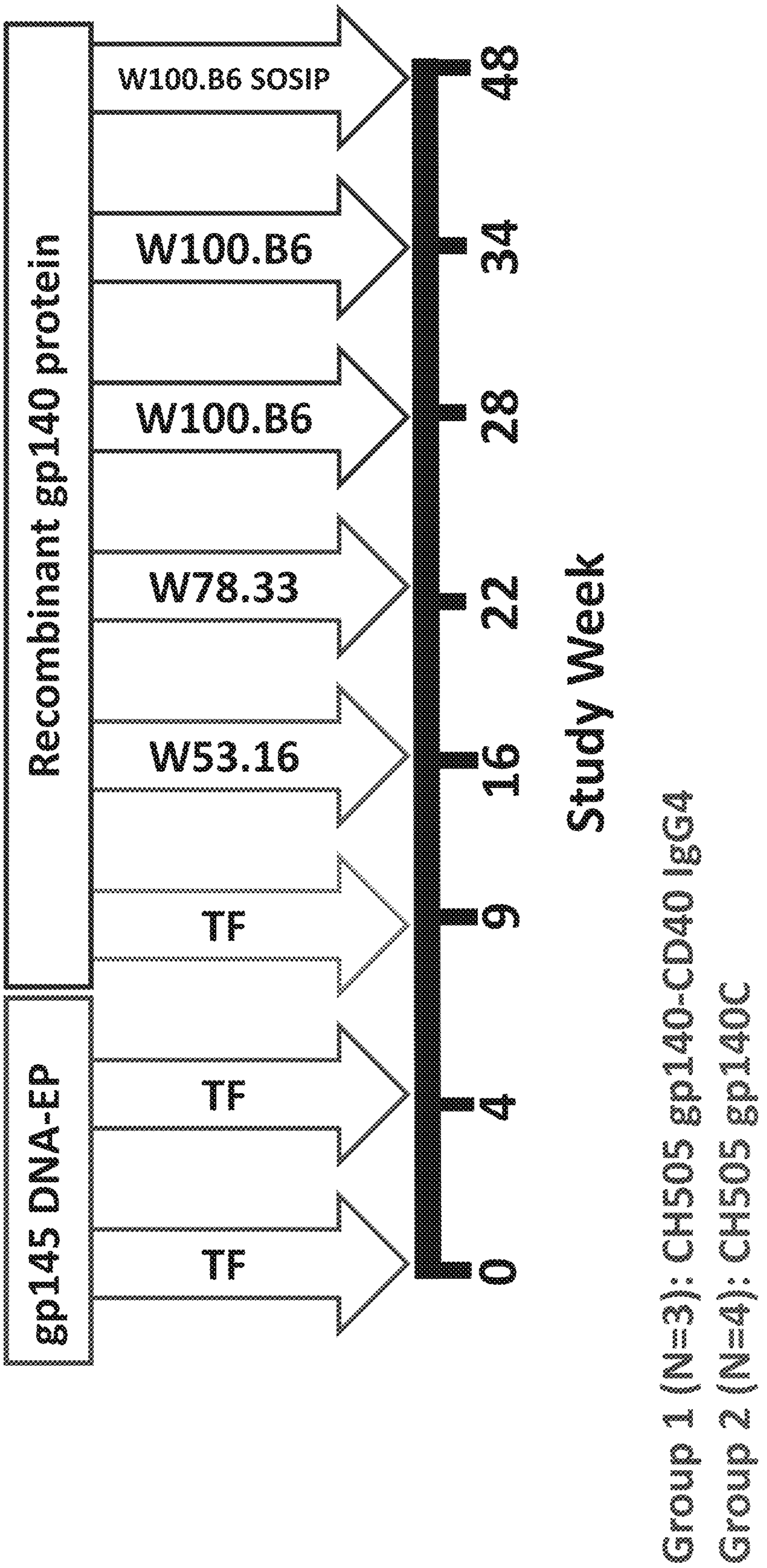

FIG. 25 shows design of rhesus macaque immunogenicity study. The immunization schedule is shown in this figure. The study compared the immunogenicity of the CD40 targeted Env to the wildtype Env in a rhesus macaque immunogneicity study. The macaques were immunized intramuscularly and electroporated twice with DNA encoding the CH505 T/F gp145. After DNA priming the macaques were administered sequential CH505 recombinant gp140C oligomers from the transmitted founder virus, and weeks 53, 78, and 100. Three macaques were immunized with the CH505 Envs conjugated to CD40 and 4 macaques were administered the CH505 Env as gp140C envelopes. We examined binding antibody titer by ELISA, neutralizing antibody titers by the TZM-bl assay, and profiled the antibody repertoire by monclonal antibody isolation. The study analyzed the immunogenicity of wildtype and CD40-targeted Env using antibody ELISA binding, TZM-bl neutralization assay, and will isolate monoclonal antibodies.

Figure 26:
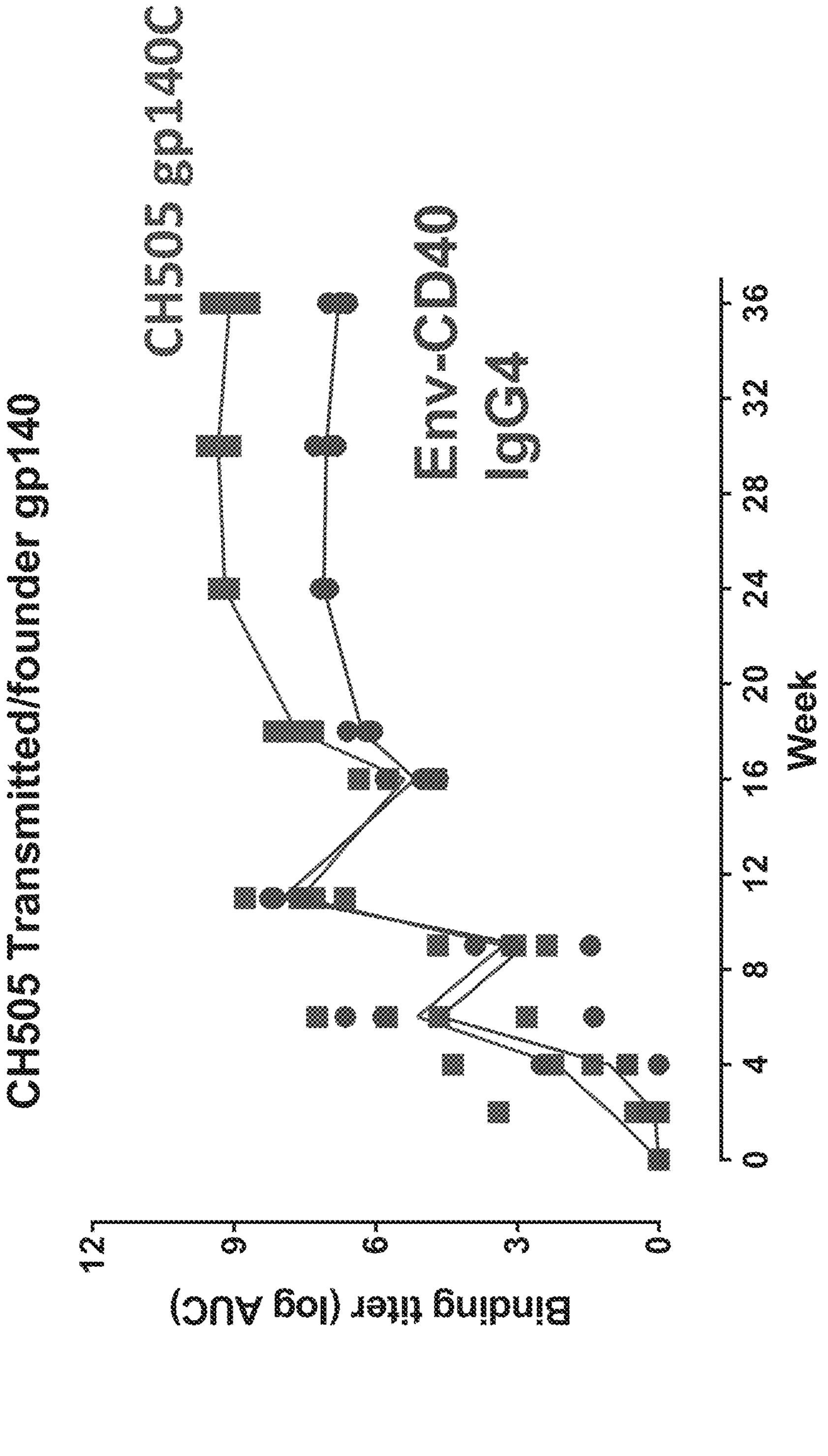

FIG. 26 shows plasma IgG responses to CH505 transmitted/founder gp140. This figure shows the binding titers over time with each symbol representing an individual macaque and the red line and symbol indicating the those animals that received the wildtype Env. The macaques that were immunized with the Env conjugated to anti-CD40 are shown in blue. The titers in both groups was comparable until week 18 which was 2 weeks after the second protein boost. After that boost with the week 53 Env the wildtype group tended to have higher binding antibody titers.

Figure 27:
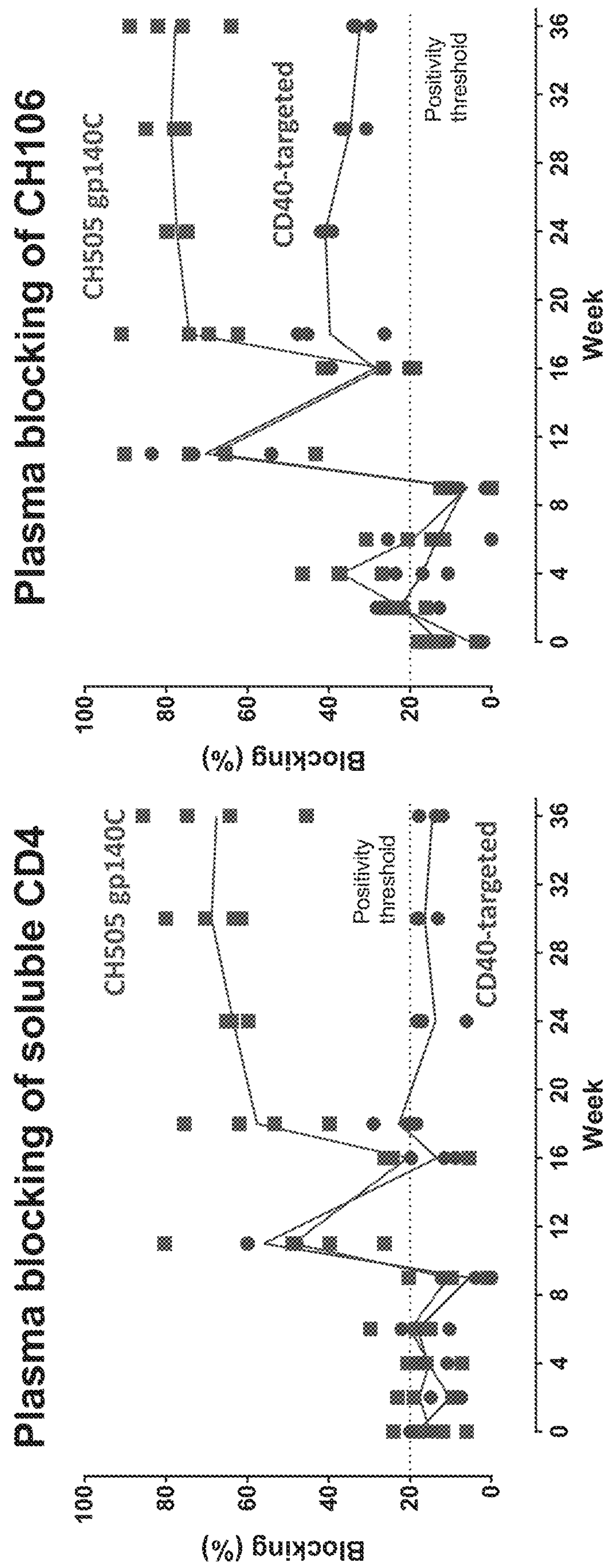

FIG. 27 shows CH505 gp140 vaccination induces plasma blocking of CD4 binding. The figure shows whether CD4 binding site antibodies were present in the plasma using competition ELISAs for soluble CD4 (shown on the left and a bnAb from the CH103 lineage called CH106 shown on the right. We examined the plasma blocking activity shown on the y-axis over time and found that at week 18 the CD4 binding site response was dramatically reduced to near background levels in the CD40 IgG4—Env group compared to the wildtype Env which showed 70 and 80% blocking of soluble CD4 and CH106 respectively.

Figure 28:
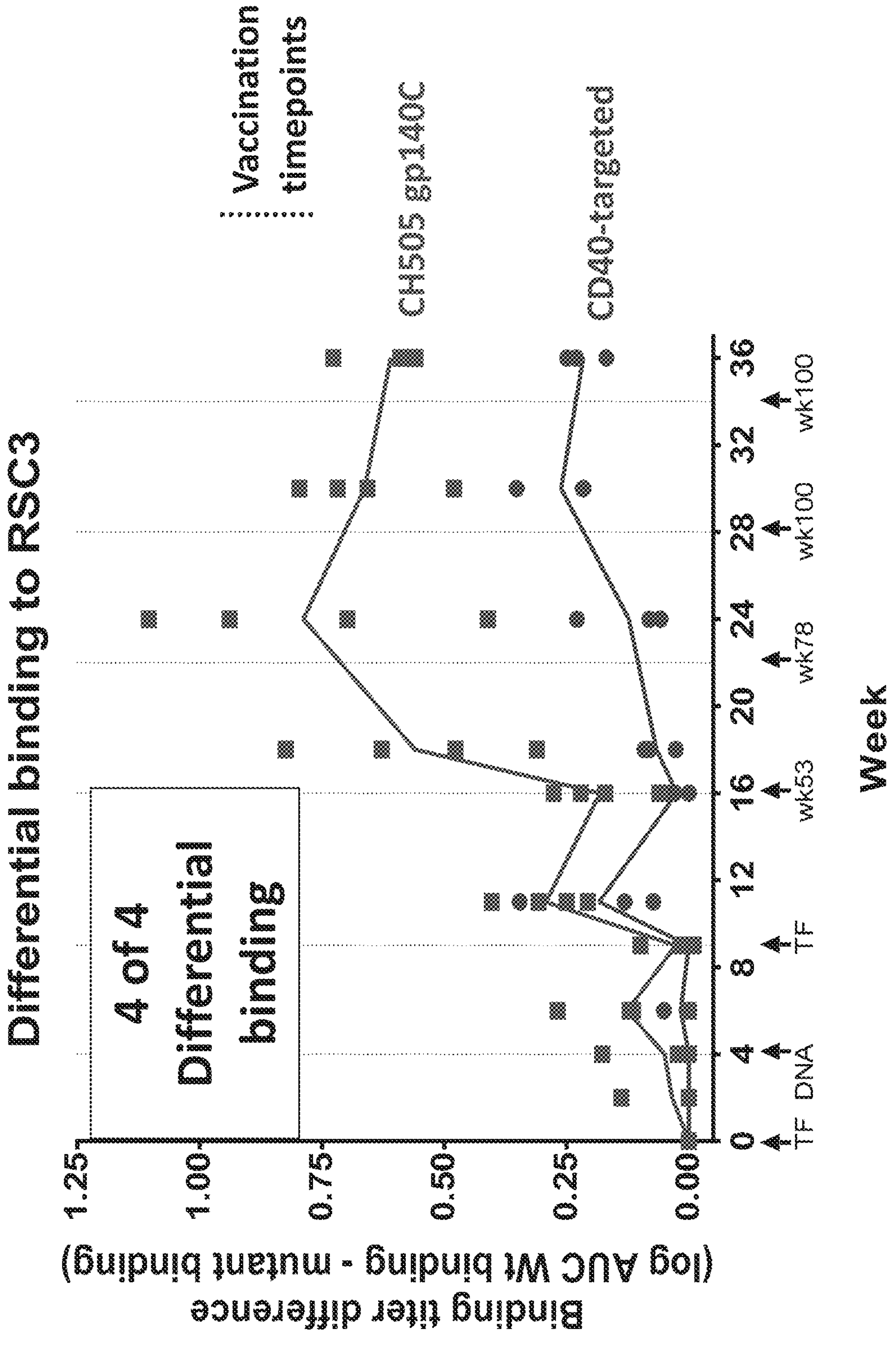

FIG. 28 shows that plasma IgG exhibits CD4 binding site-directed binding to a resurfaced gp120 core. This figure shows the ability of the plasma IgG from all four animals to bind to RSC3 or its CD4 knock out mutant. Shown here is the difference in binding between the wildtype RSC3 and the CD4 binding site mutant over time.

Figure 29:
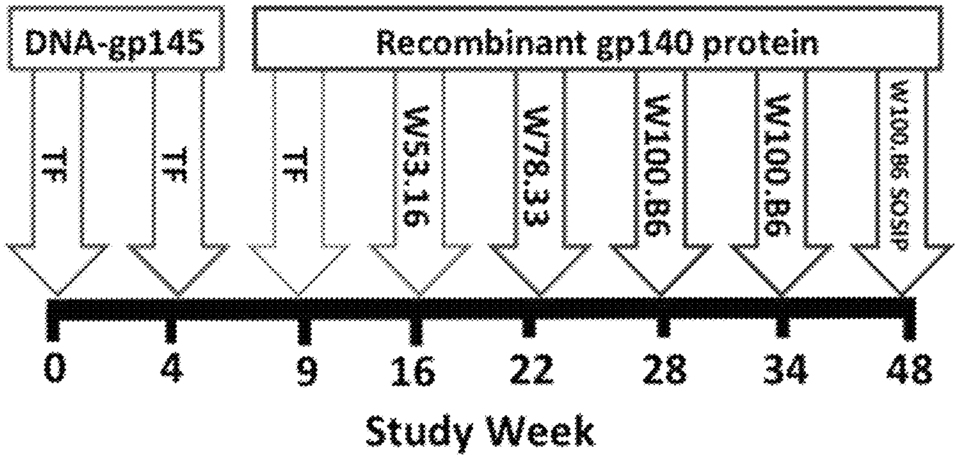

FIG. 29 shows CH505 gp140 vaccination elicits high titers of autologous tier 1 virus neutralization. This figure shows the neutralization titers for each macaque represented as ID50 reciprocal dilutions against a tier 1 virus called CH505 w4.3 isolated from the CH505 individual early in infection. All 4 animals generated relatively high titers of tier 1 neutralizaing antibodies beginning with the protein boost. The titers were increased with subsequent boosts with the sequential vaccine, and notably these tier 1 neutralizing antibodies were typical for our CH505 Env vaccinations that have been performed in macaques.

Figure 30:
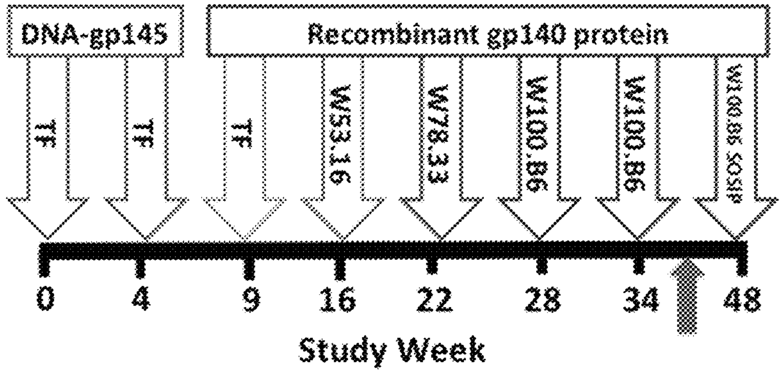

FIG. 30 shows CH505 gp140 sequential vaccination boosts autologous tier 2 CH505 TF virus neutralization. This figure shows autologous tier 2 neutralization by the plasma from each macaque. The ID50 titers are shown for each macaque and we observed 1 of 4 macaques generated autologous tier 2 neutralizing antibodies in the plasma. Detectable neutralization first occurred after the CH505 week 53 Env protein boost and increased with each boost. This result was striking since this macaque was the first vaccinated macaque where we observed neutralization of the CH505 TF virus.

Figure 31:
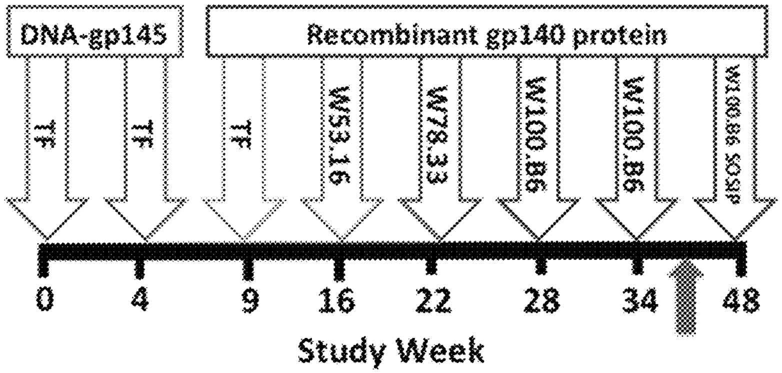

FIG. 31 shows autologous neutralizing antibodies against all four tier 2 viruses increased with sequential boosting. This figure shows the autologous tier 2 neutralization analysis to include the tier 2 CH505 viruses that comprise the sequential vaccination regimen. The same macaque 6207 was able to neutralize all four tier 2 CH505 viruses. The neutralization was detectable against 3 of 4 of the CH505 viruses after only 2 protein boosts, and by three boosts all 4 viruses were neutralized. We saw the neutralizing titers continued to increase with each boost.

FIG. 32 shows NHP 6207 neutralizes heterologous tier 2 virus representative global isolates. While autologous tier 2 neutralization is difficult to elicit, heterologous tier 2 neutralization is even more rare to observe in vaccinated primates. To determine whether tier 2 heterologous breadth was elicited in macaque 6207 plasma we tested neutralization against heterologous tier 2 viruses selected to represent the global circulating viruses. We examined neutralization of this 12 virus panel by the plasma at week 30-post 4 sequential protein boosts and week 36 post 5 sequential protein boosts. After 4 protein boosts two heterologous tier 2 viruses were neutralized. After the subsequent boost 9/12 of the viruses were neutralized. Although the titers were low this antibody response appears boostable and is currently the broadest tier 2 neutralization known to be achieved in a vaccinated primate.

Figure 33:
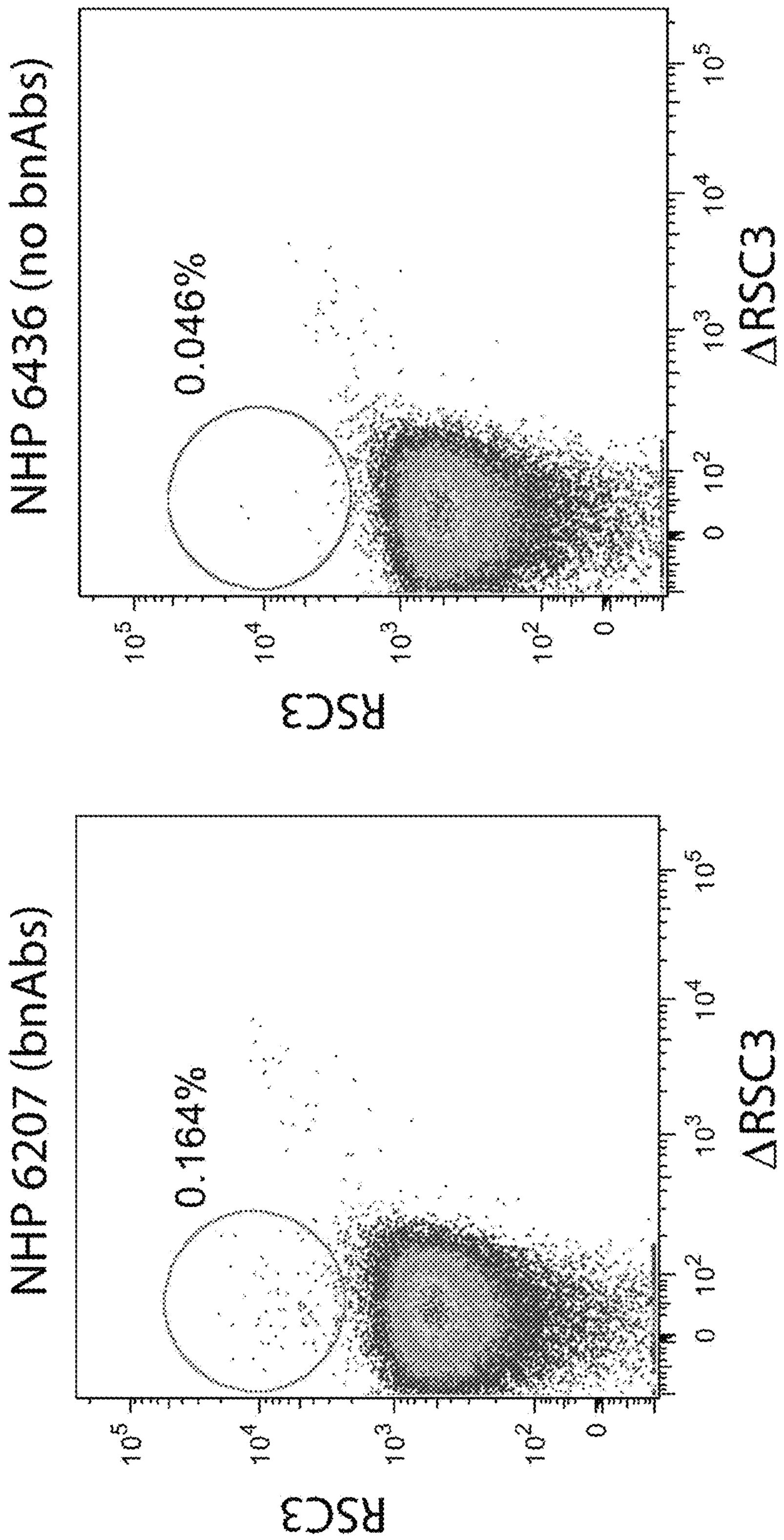

FIG. 33 shows B cell sorting for CD4 binding site differential antibodies. Memory B cells from two macaques were sorted and compared the presence of RSC3-reactive B cells that did not bind the CD4 knock out mutant version of the protein called delta RSC3. A representative FACS plot is shown on the left for the NHP 6207 who possessed SCL70 reactive plasma IgG and developed broadly neutralizing antibodies in its plasma. For comparison we sorted RSC3-reactive B cells from NHP 6436, which did not have broad neutralization in the plasma but was the other macaque that tested positive for auto antibodies. The NHP 6207 had a relatively large percentage of RSC3 reactive B cells whereas NHP6436 had very few.

Figure 34:
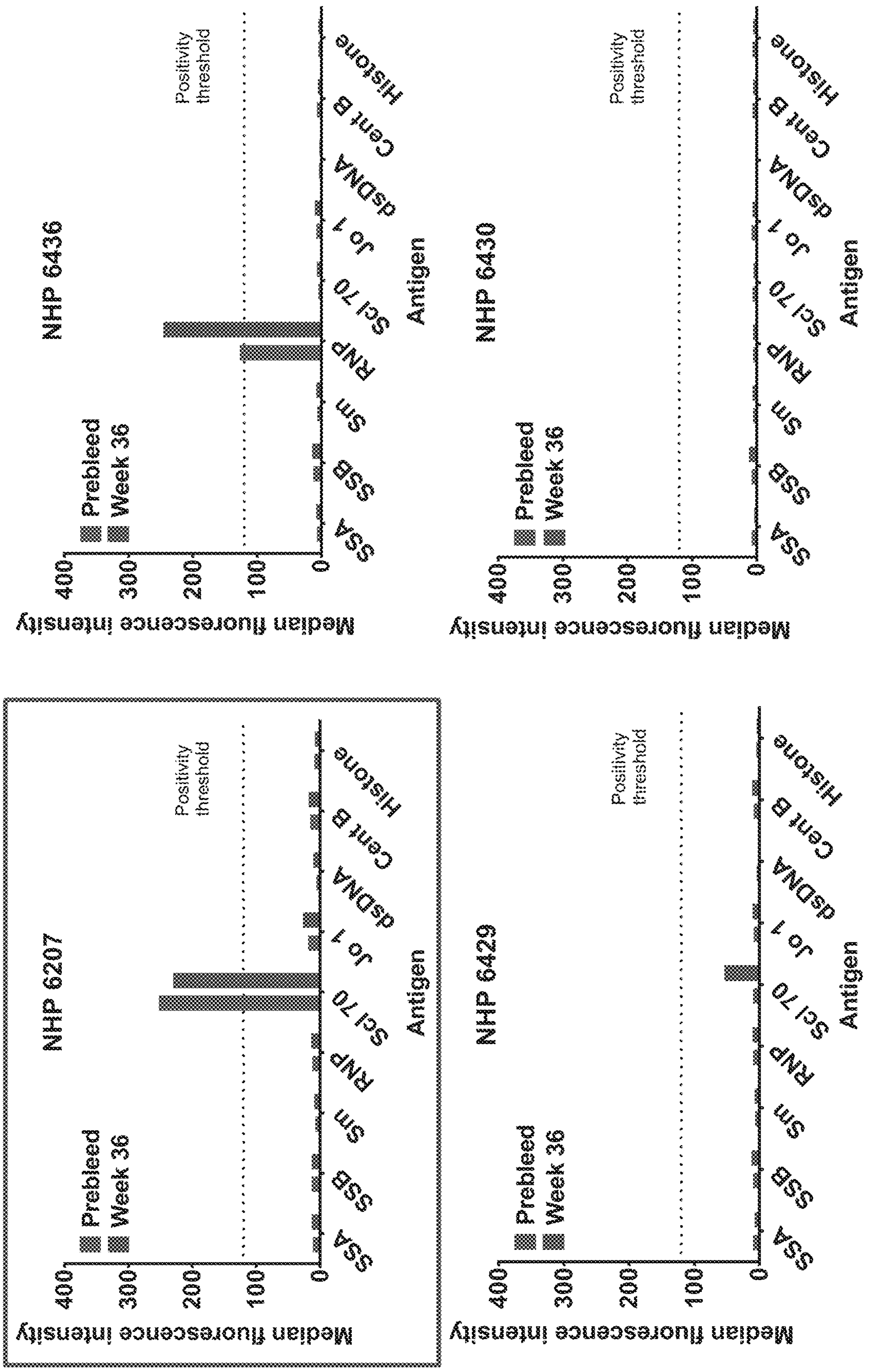

FIG. 34 shows macaque 6207 has broad plasma neutralization and antibodies against Scl70. This figure shows autoreactivity measured in the Athena assay for each of the four macaques that received the wildtype CH505 gp140C envelopes in vaccination. Median fluorescence intensity for binding to each autoantigen listed on the x-axis is depicted in separate graphs for each macaque. The positivity threshold for the assay is marked by the dotted line. Interestingly, the macaque that possessed broad neutralization possessed binding antibodies to the autoantigen SCL70, which is correlated of the autoimmune disease scleroderma. The antibodies were present prior to vaccination indicated by the binding in the grey bar. One other macaque tested positive for autoantibodies, but it bound to a different autoantigen.

Figure 35:
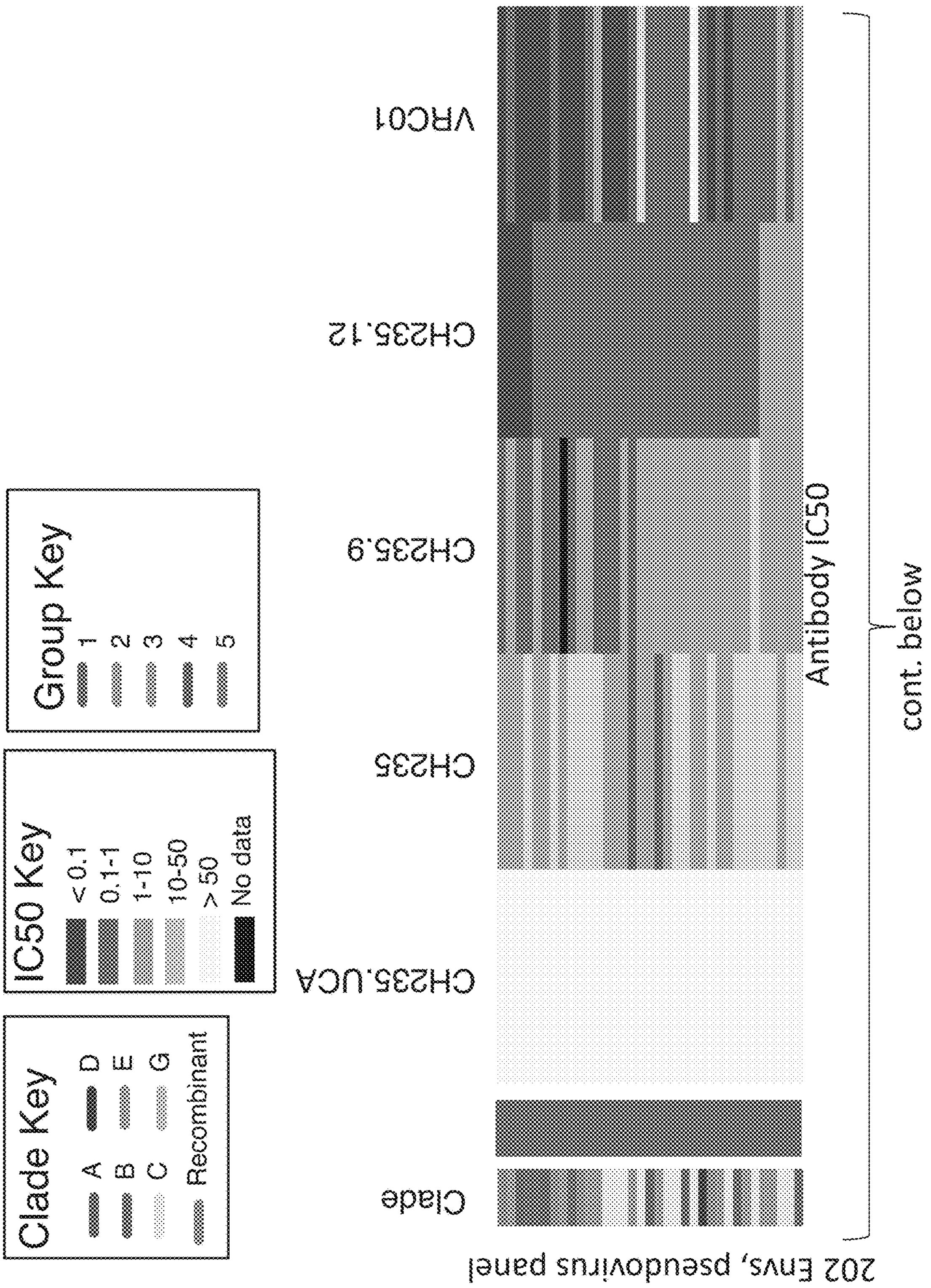
Figure 35:
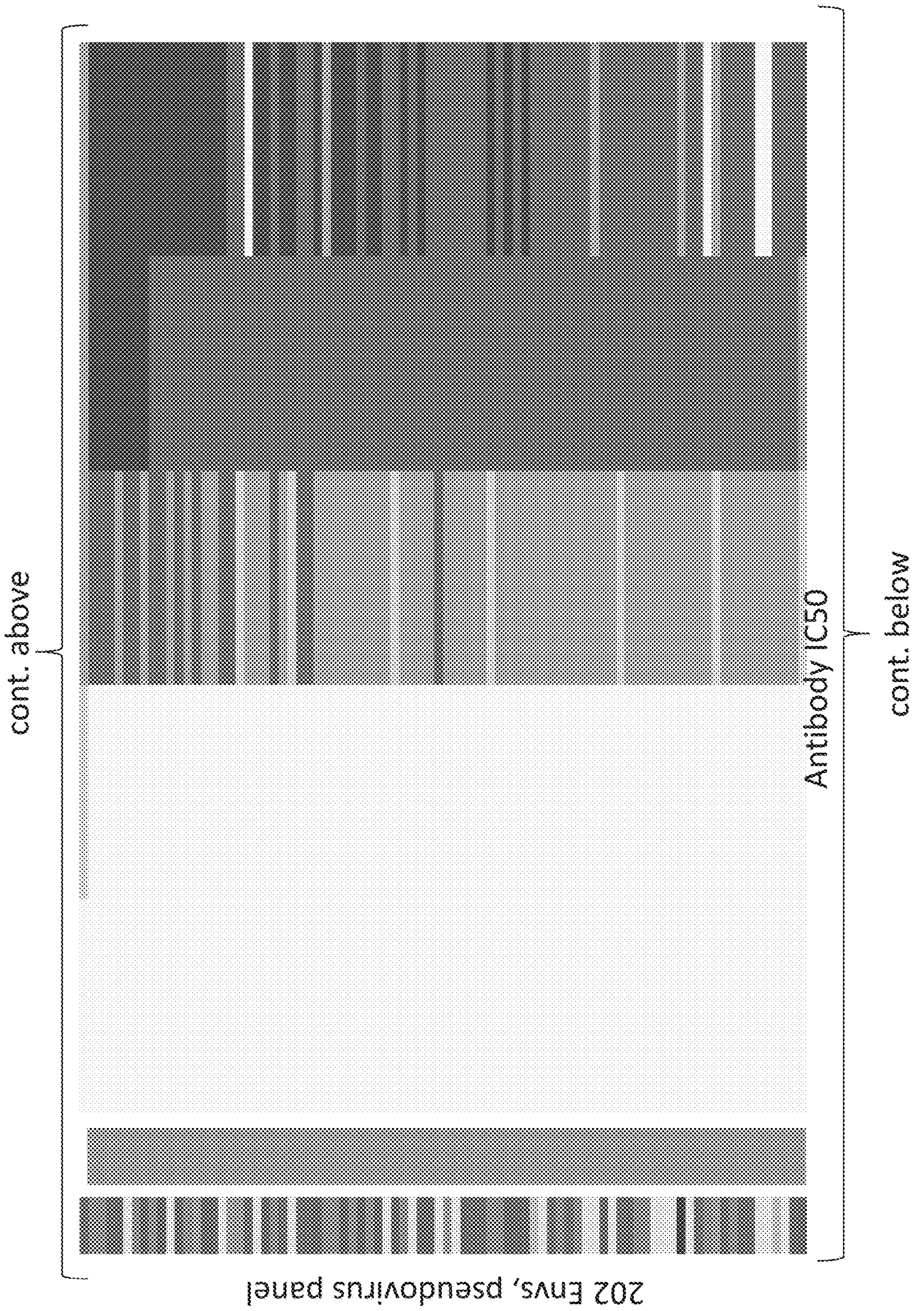
Figure 35:
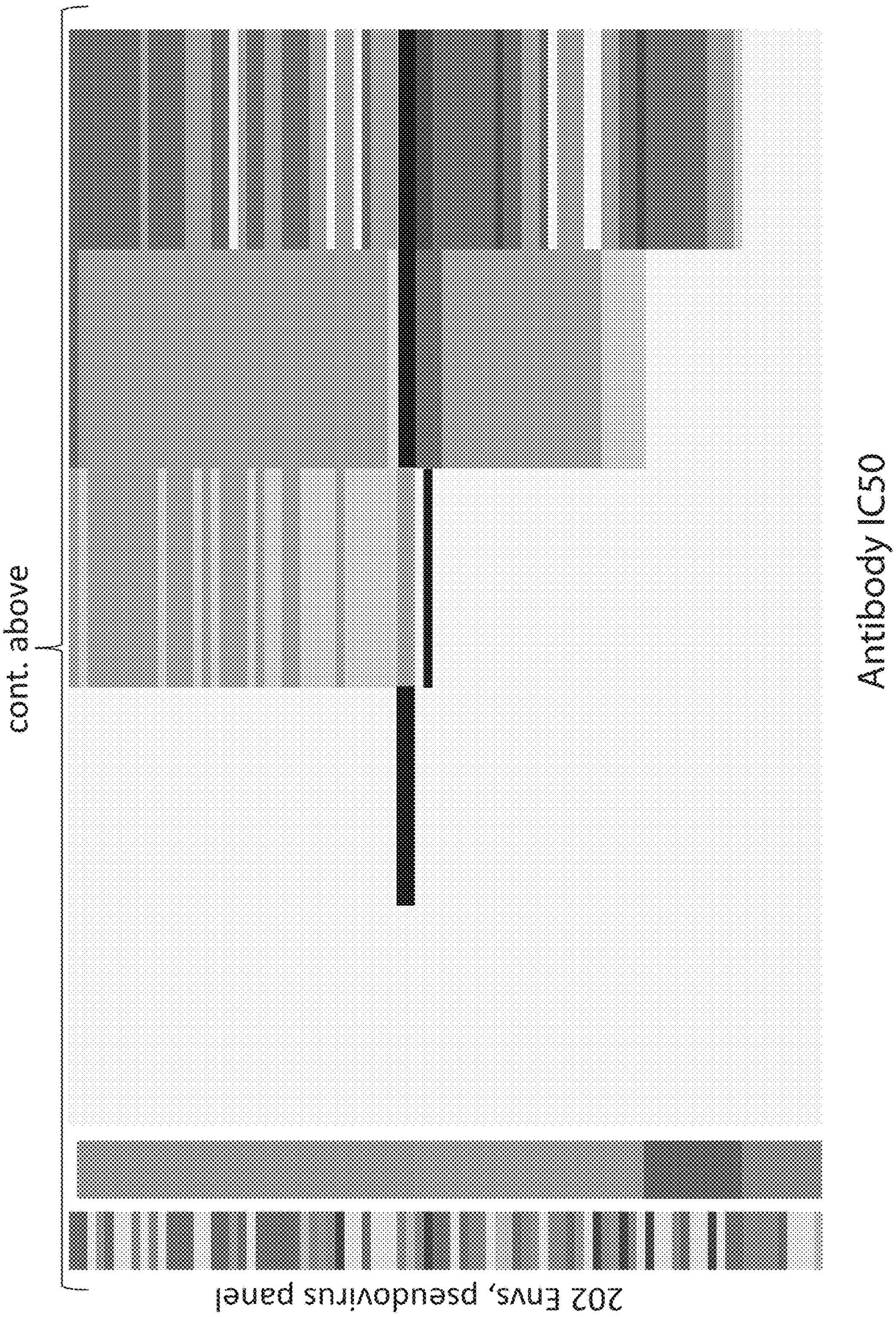

FIG. 35 shows a heterologous panel heatmap of IC50s.

Figure 36:
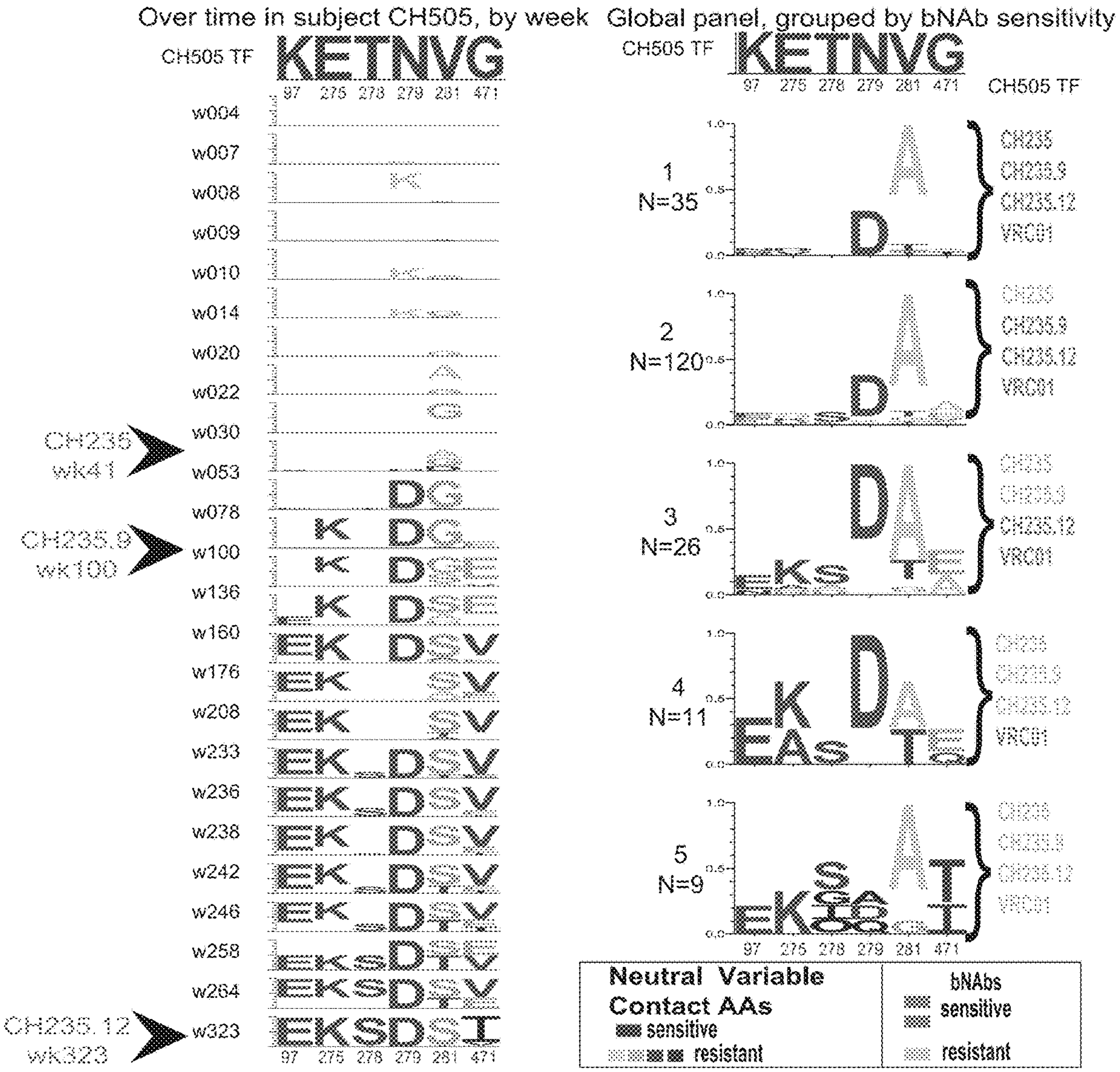

FIG. 36 shows the global panel, grouped by bNAb sensitivity (right panel). Env mutations over time in subject CH505, by week is shown in the left panel.

Figure 37:
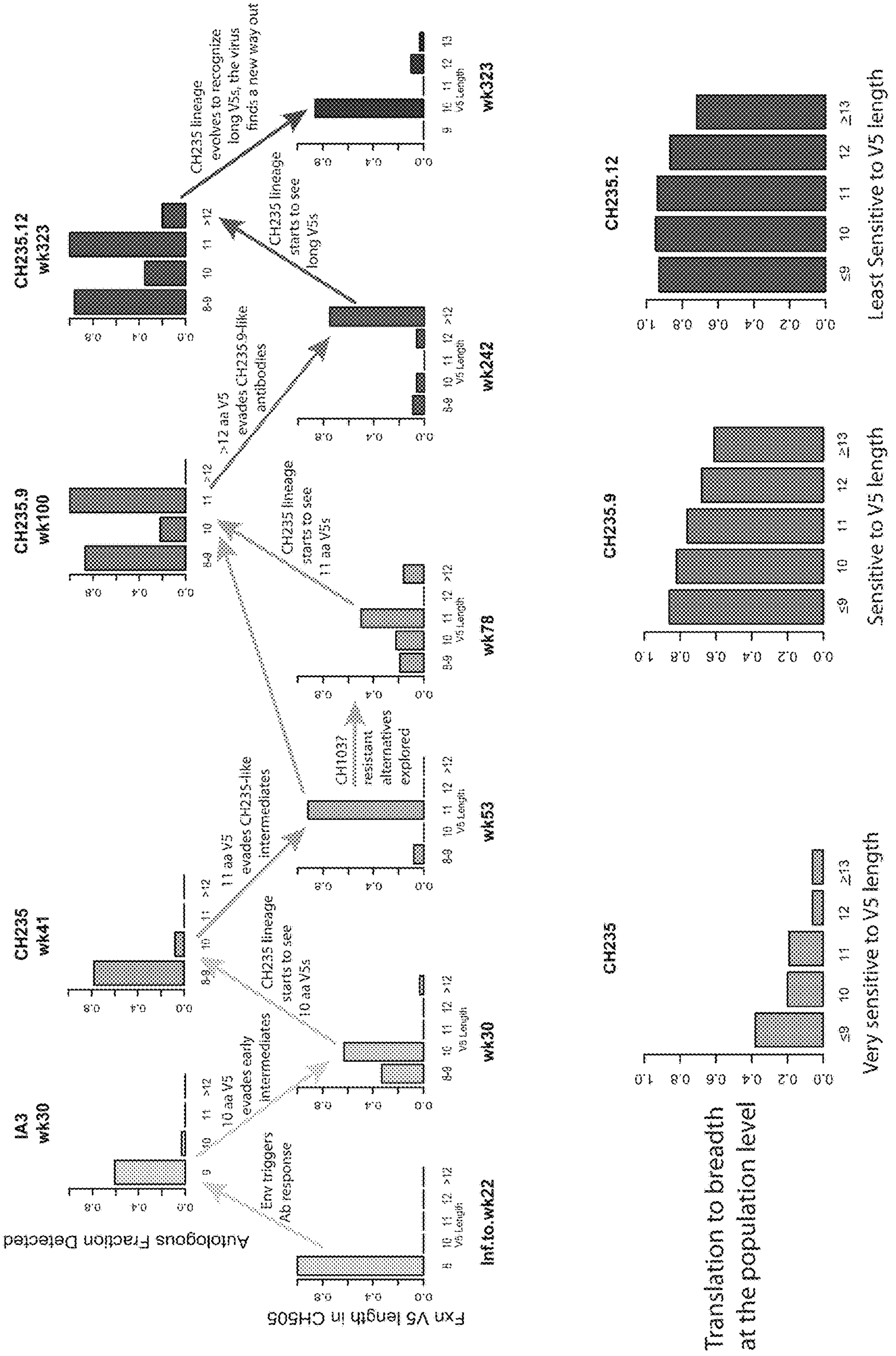

FIG. 37 shows V5 selection yields population breadth.

FIG. 38 shows mutations and V5 length.

Figure 39:
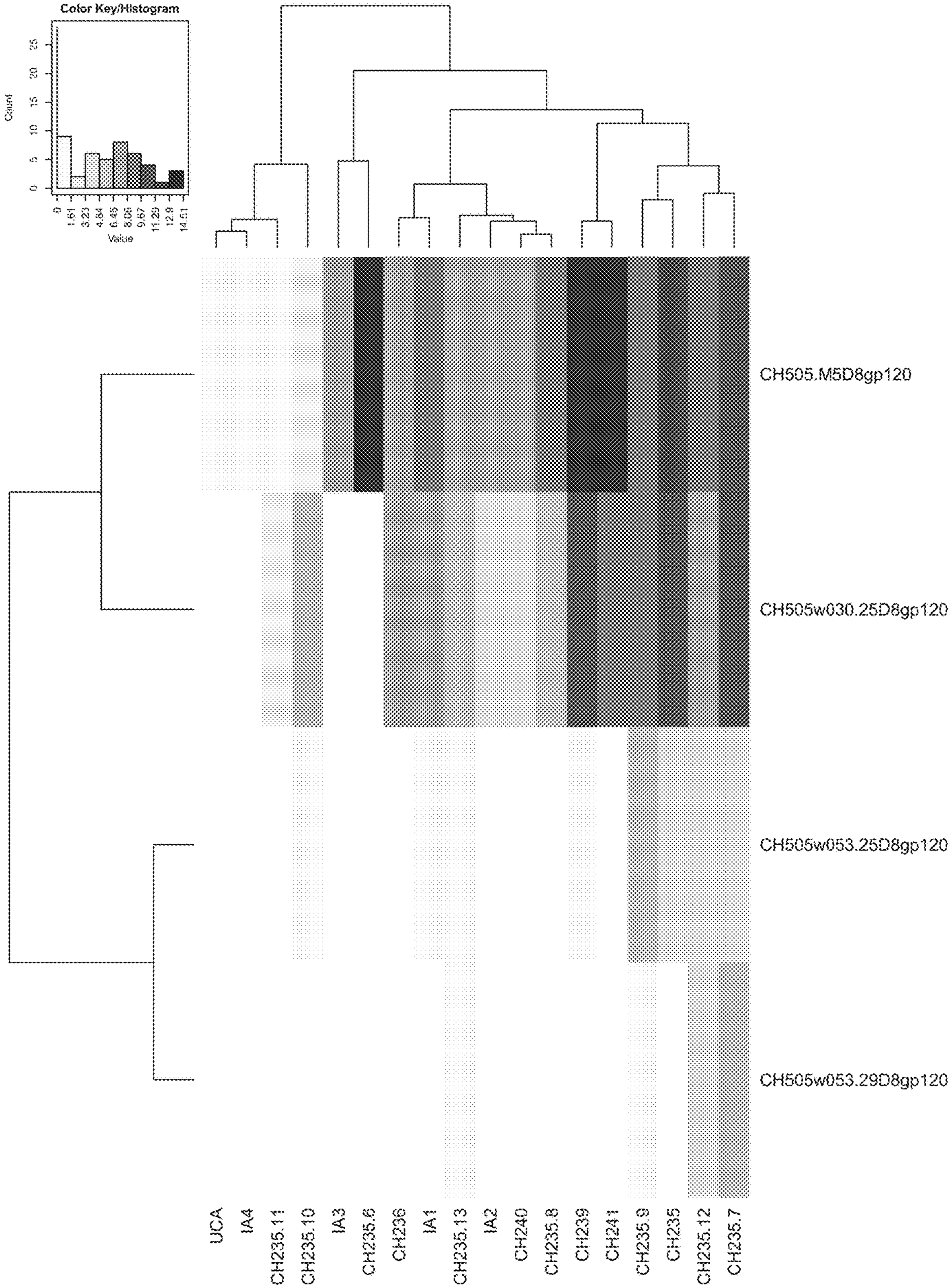

FIG. 39 shows a selection of four envelopes from CH505 and their binding to CH235 lineage antibodies.

Figure 40:
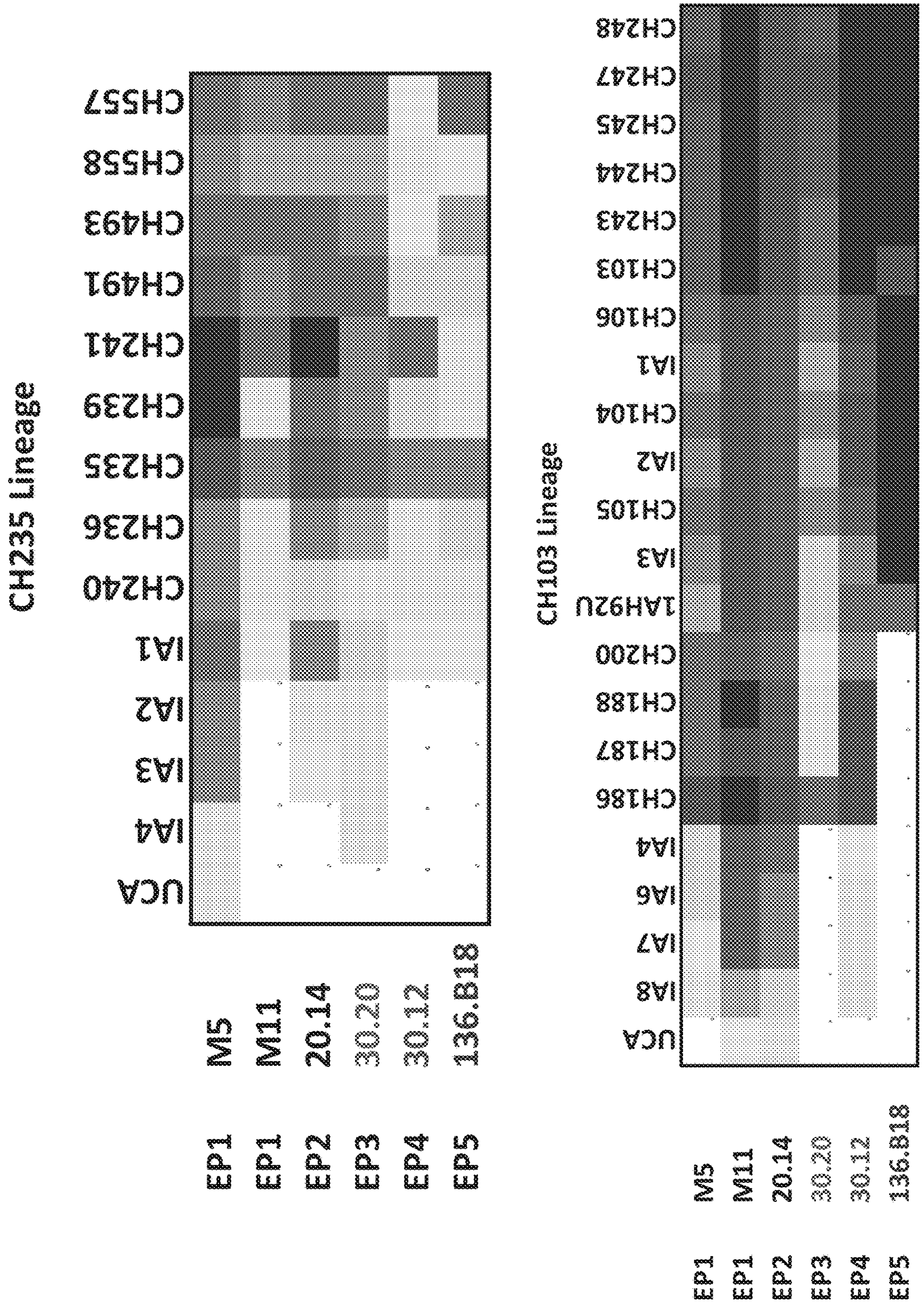

FIG. 40 shows a selection of CH505 immunogens to drive both CH103 and CH235 CD4 binding site types of broad neutralizing B cell lineages.

Figure 41A:
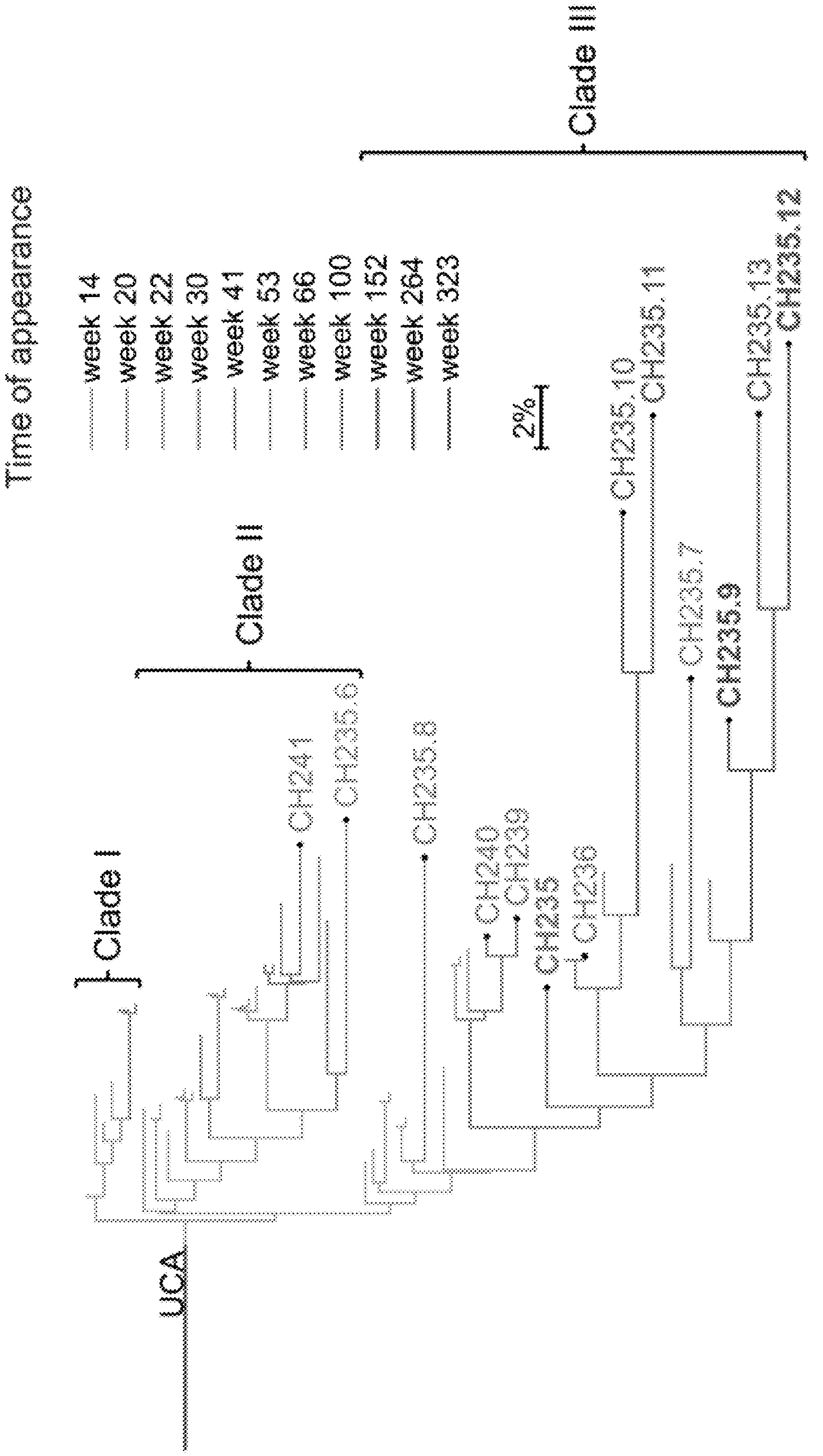
Figure 41B:
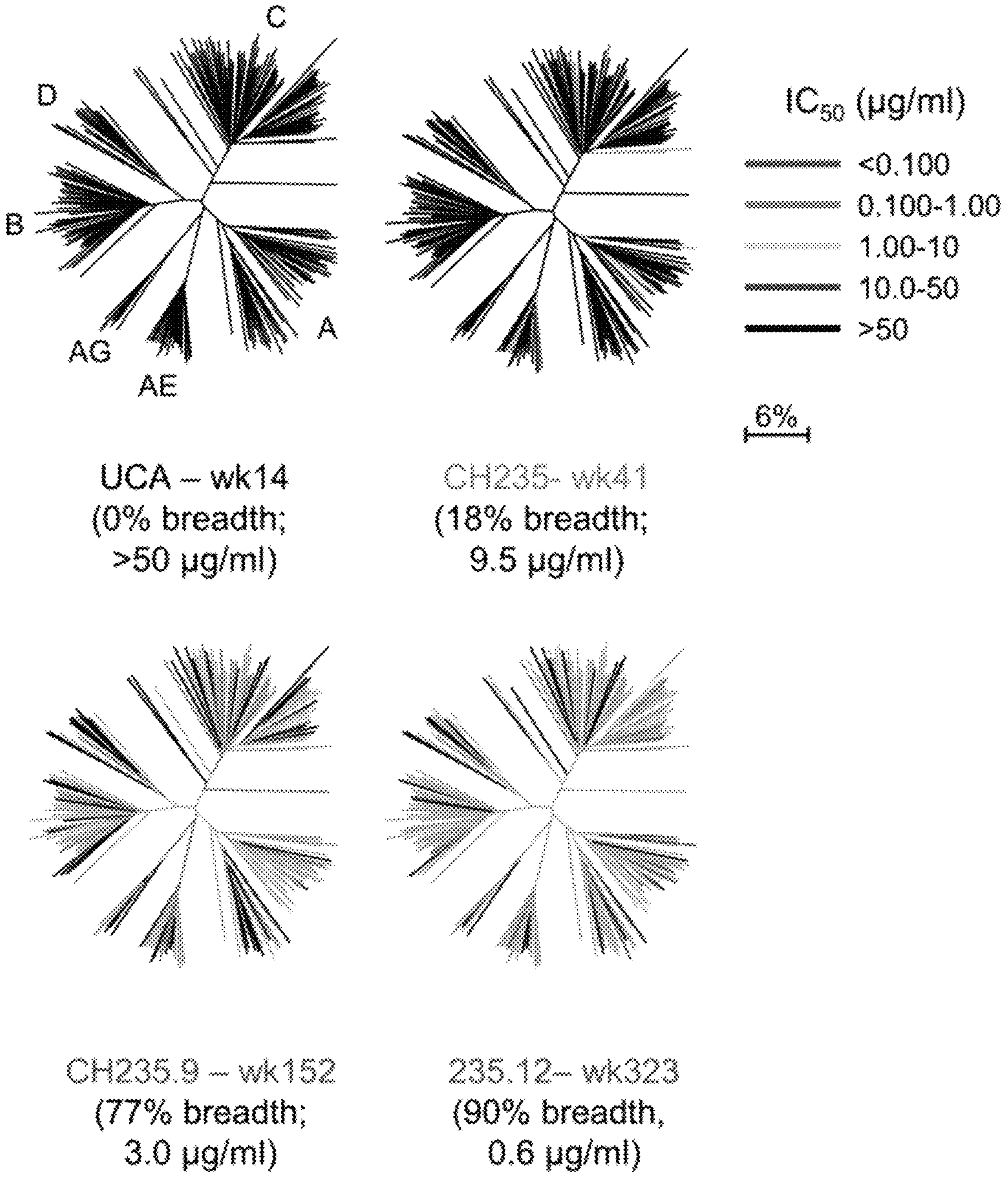

FIGS. 41A-B show CH235 Lineage, with Time of Appearance and Neutralization by Select Members. (A) Phylogram of CH235 lineage. Phylogenetic tree is colored by first time (wk post-infection) from which sequences were obtained. Key members of the CH235 lineage are labeled. CH235.6, CH235.7, CH235.8 and CH235.9 $V_H$ were complemented with full heavy chain gene regions and paired with the $V_L$ from the closest natural antibody. (B) Neutralization dendrograms display single mAb neutralization of a genetically diverse panel of 199 HIV-1 isolates. Coloration is by $IC_{50}$. See also FIGS. 48A-B, 53, and 54.

FIGS. 42A-E show structures of CH235-Lineage Members in Complex with HIV-1 Env. (A) Co-crystal structures of the antigen-binding fragments (Fabs) of CH235-lineage members with core gp120. Structures are shown in ribbon diagram, with gp120 in gray and residues altered by SHM in stick representation colored by time-of-appearance. (B) Negative stain EM of Fabs of CH235-lineage members and trimeric HIV-1 Env from BG505 (top row) and B41 (bottom row). Structures in surface representation, with Env portions colored gray and Fabs by time-of-appearance. (C) Epitope displayed on the gp120 surface and colored by antibody time-of-appearance, with the vulnerable portion of the CD4bs highlighted in yellow and select regions labeled. (D) Targeting precision of CD4bs-directed antibodies vs neutralization breadth. (E) $V_H$-gene SHM of CD4bs-directed antibodies vs neutralization breadth. See also FIGS. 49A-G and FIG. 55.

Figure 43A:
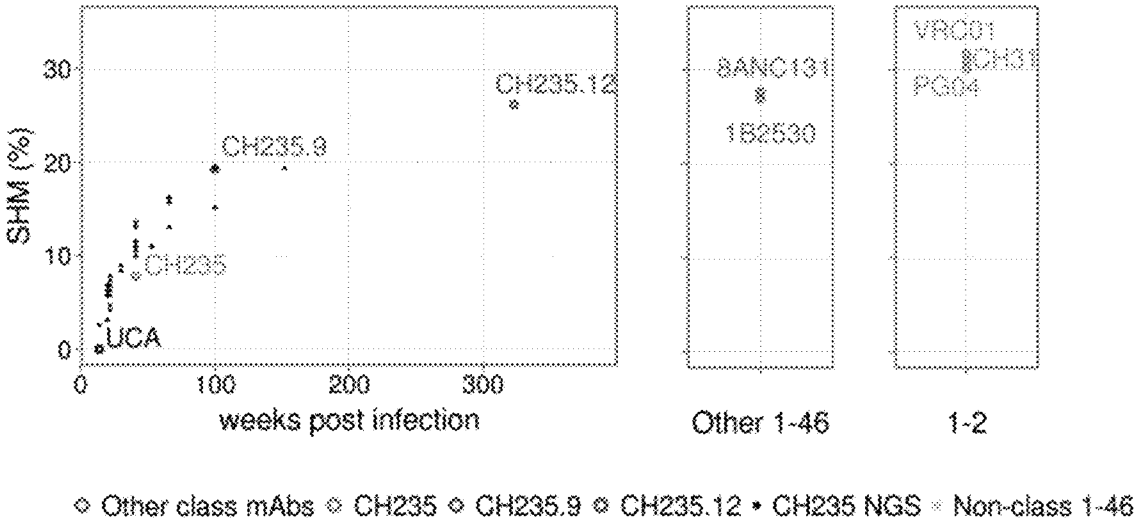
Figure 43B:
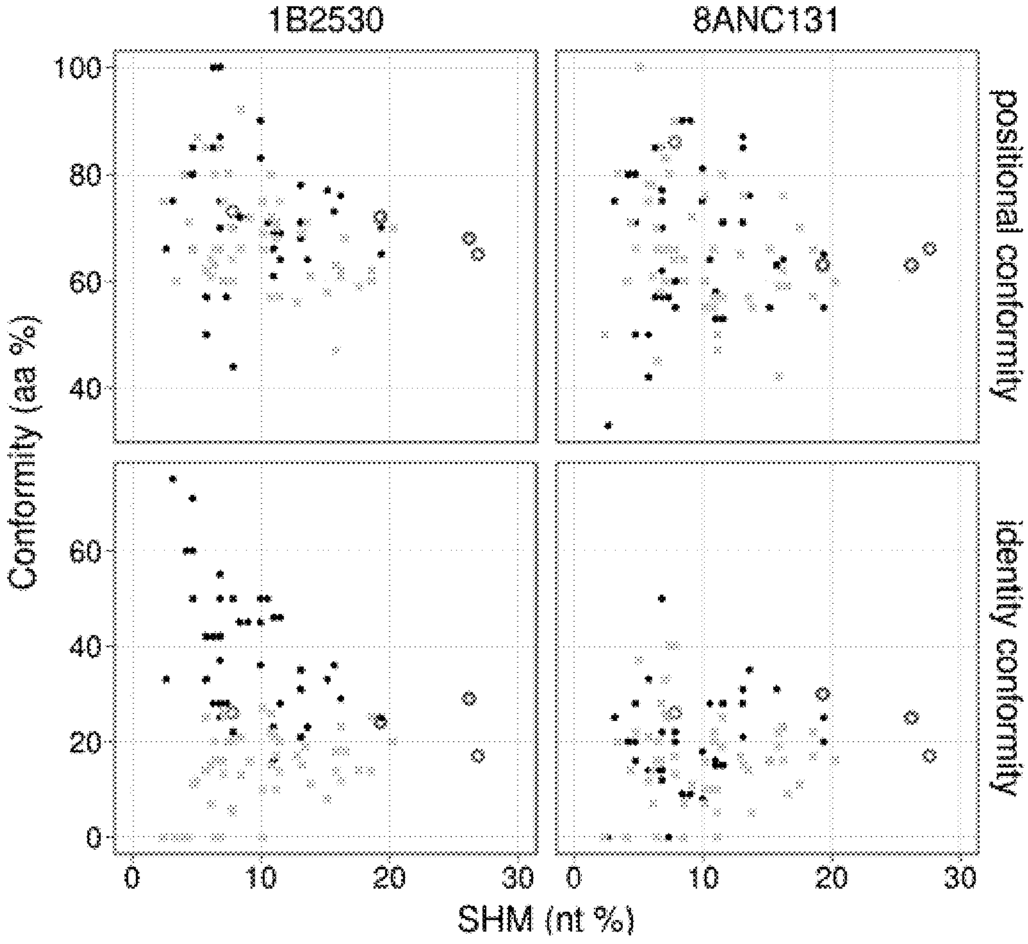
Figure 43C:
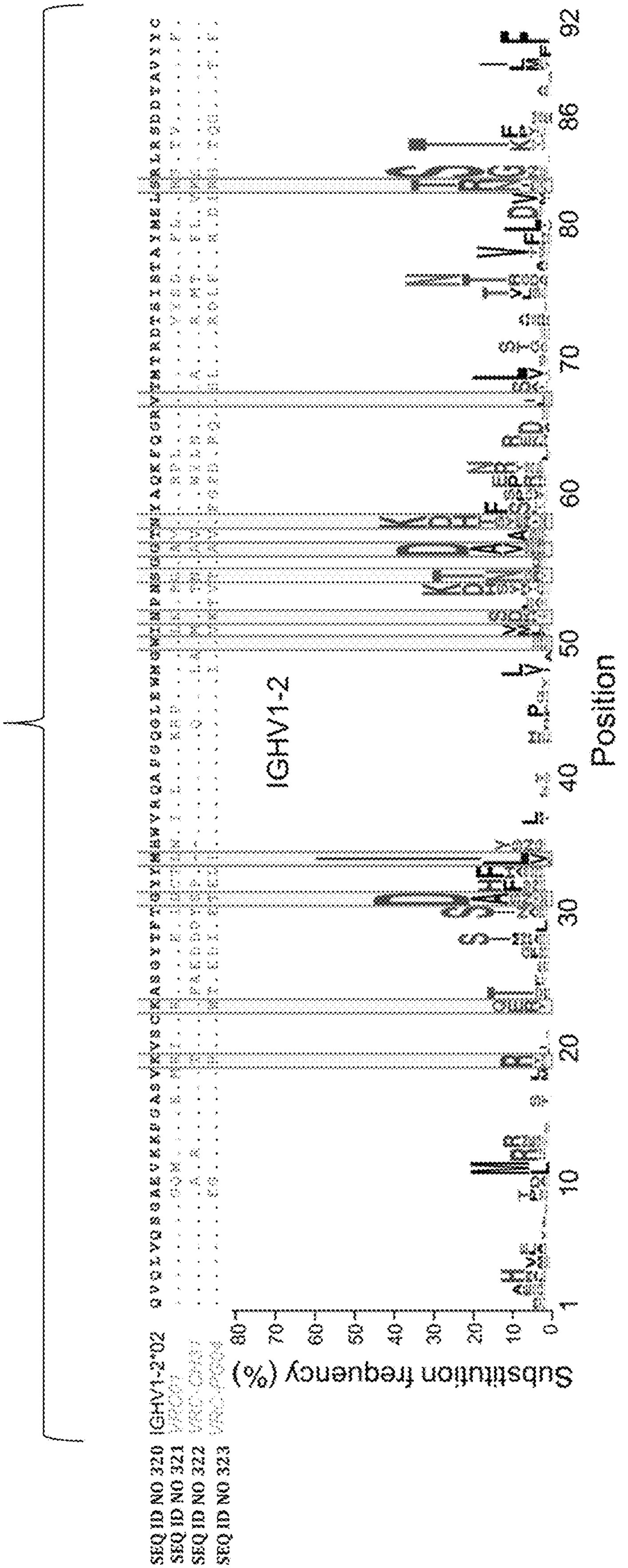

FIG. 43A-C shows sequence Evolution of CH235 Lineage: SHM, Timing, and Conformity of CH235-Lineage Development from UCA to Antibody with 90% Breadth. (A) Heavy chain SHM over time for the CH235 lineage (left panel). SHM levels of other $V_H$1-46-derived CD4bs mAbs and selected $V_H$1-2-derived VRC01-class mAbs are shown (middle and right panels, respectively); the time since infection is unknown for these mAbs. (B) Maturation conformity vs overall heavy chain SHM. Positional conformity (top row) is defined as the number of aa positions differing from the germline sequence in both the conforming and reference sequences, divided by the total number of aa changes in the conforming antibody. Identity conformity (bottom row) is defined as the number of such positions which are additionally mutated to the same residue, divided by the total number of mutations in the conforming antibody. Conformity to 1B2530 (left) and to 8ANC131 (right) is shown for both position and identity. (C) $V_H$-gene mutability accounts for the majority of positional conformity of CH235 lineage. The mutability of the $V_H$-gene for $V_H$1-46 (top) and $V_H$1-2 (bottom) is shown. Sequence logos are shown at each position; the height of each logo corresponds to the percent of mutated reads. Green bars are shown for SHM in antibody CH235, which are altered in over a quarter of $V_H$1-46-derived antibodies. See also FIGS. 50A-E and 56A-C. FIG. 43C discloses SEQ ID NOS 314-323, respectively, in order of appearance.

FIGS. 44A-D show binding Kinetics of CH103 and CH235 Lineage Antibodies. Binding association ($k_a$) and dissociation ($k_d$) rates of the CH103 (A-B, squares) and CH235 (C-D, circles) lineage mAbs to CH505.TF gp120 Env were measured with SPR and used to calculate the dissociation rate constants ($K_d$). $K_d$s are shown in A and C, $k_a$ (solid lines, plotted on the left y-axis) and $k_d$ (dashed lines, plotted on the right y-axis) are shown in B and D. See also FIGS. 57A-B.

Figure 45A:
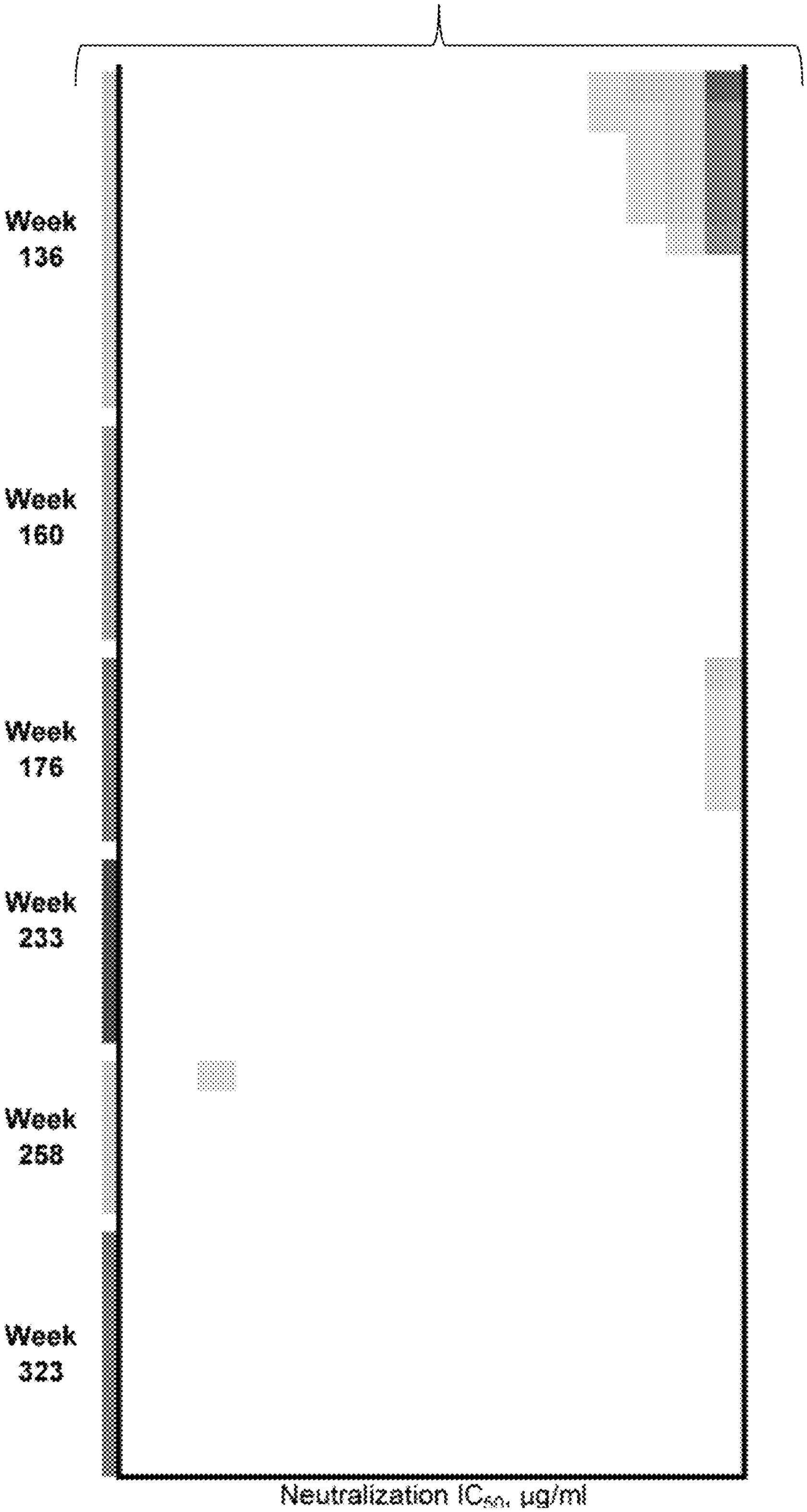

FIGS. 45A-C show CH235 Lineage Antibodies Neutralization of Autologous Virus and CH505.TF Loop D Mutants. (A) Heatmap analysis of neutralization of 76 pseudoviruses (row) by 16 CH235 lineage mAbs (column). Coloration is by $IC_{50}$. This analysis extends previous observations on early CH235 lineage antibodies (Gao et al., 2014) by including late mAbs CH235.7, CH235.8, CH235.10, CH235.11, CH235.12 and CH235.13 and by adding pseudoviruses isolated from wk 136 to 323 post-transmission. (B) CH505 TF and loop D mutants M5, M6, M10, M19, M11, M7, M8, M9, M20 and M21 neutralization by CH236 mAb, late mAbs CH235.7, CH235.9 CH235.10, CH235.11, CH235.12, CH235.13 (left panel) and CH235.9 mAb mutants (right panel). Neutralization is expressed as $IC_{50}$ μg/ml. CH505 TF sequence mutations are shown on the right. (C) The CDR H1 N30 (sticks, dark red) in CH235.9, which interacts with the β20-β21 loop in the bridging sheet of gp120 (cyan), is over 19 Å away from the N280S mutation site in loop D (orange). See also FIGS. 51A-B, 58, and 59.

Figure 46A:
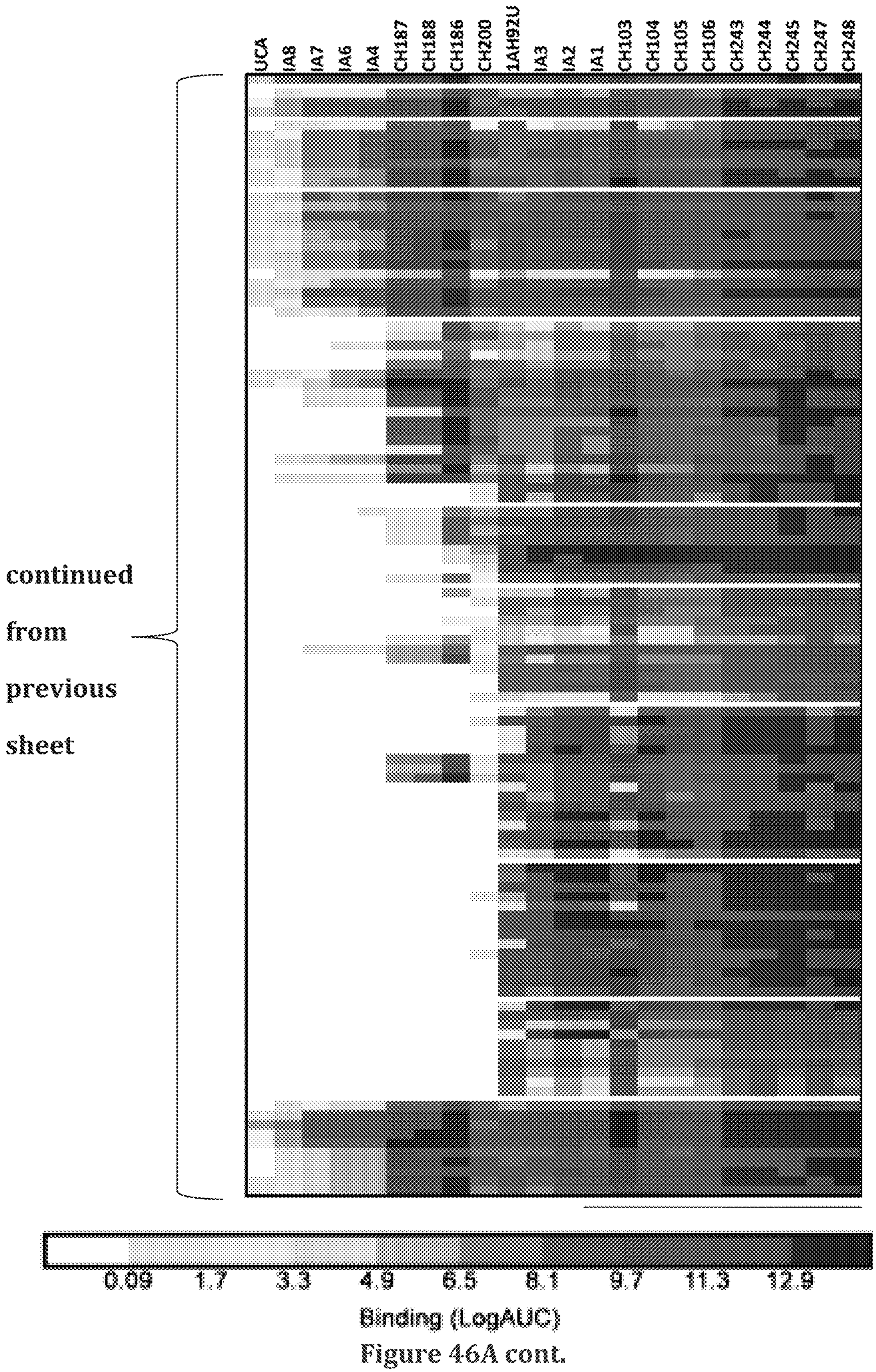
Figure 46B:
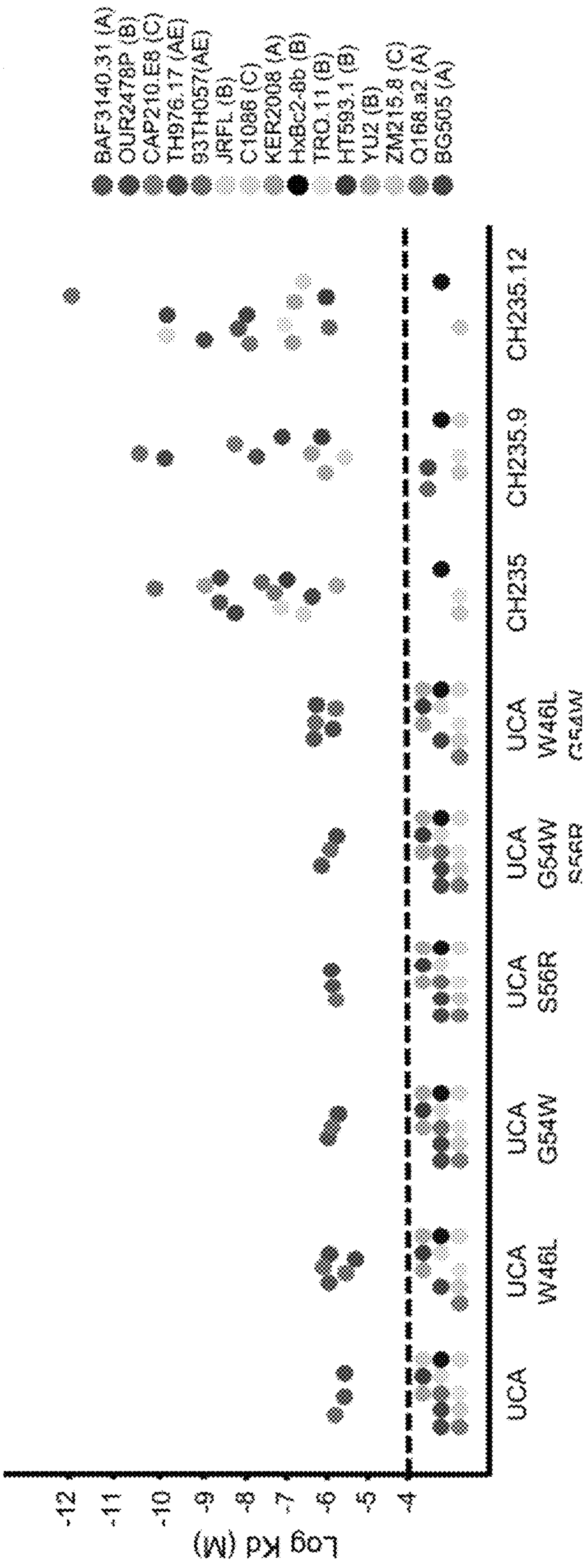

FIGS. 46A-B show binding of CH235 and CH103 Lineage mAbs to Autologous CH505 (A) and CH235 UCA Binding to Heterologous HIV-1 Env Glycoproteins (B). (A) Heatmap analysis of UCA, intermediate (IA) and mature CH235 and CH103 lineage mAbs binding to 113 CH505 autologous Env isolated from time of infection (TF) to 160 wks post-infection and to the CH505.TF mutants (Gao et al., Cell 2014). Mabs were tested in ELISA at concentrations ranging from 100 μg/ml to 0.6 ng/ml. Binding is expressed as a LogAUC. (B) Affinity of CH235 UCA, CH235 wild-type and select SHM variants to a panel of 15 heterologous gp120 Envs. See also FIGS. 52A-B and 60.

FIGS. 47A-D show CH235 Antibody Lineage Auto- and Polyreactivity. (A) CH235 lineage antibody binding to ANA measured in ELISA. LogAUC was calculated from duplicate samples. Results representative of duplicate experiments. (B) Binding to cardiolipin was determined using Quanta Lite ACA IgG III ELISA Assay. (C) Hep2 cell IF staining. Size bars=50 μm. (D) Measurement of polyreactivity against 9,400 human antigens using ProtoArray 5 microchip: CH235 lineage mAbs binding (x-axis) was compared to non-polyreactive control mAb 151K (y-axis). Polyreactivity is defined as 1 log stronger binding than 151 k mAb to more than 90% of the test proteins. High affinity binding was measured as a >2 log increase in binding (dotted line) (Liu et al., 2015).

Figure 48A:
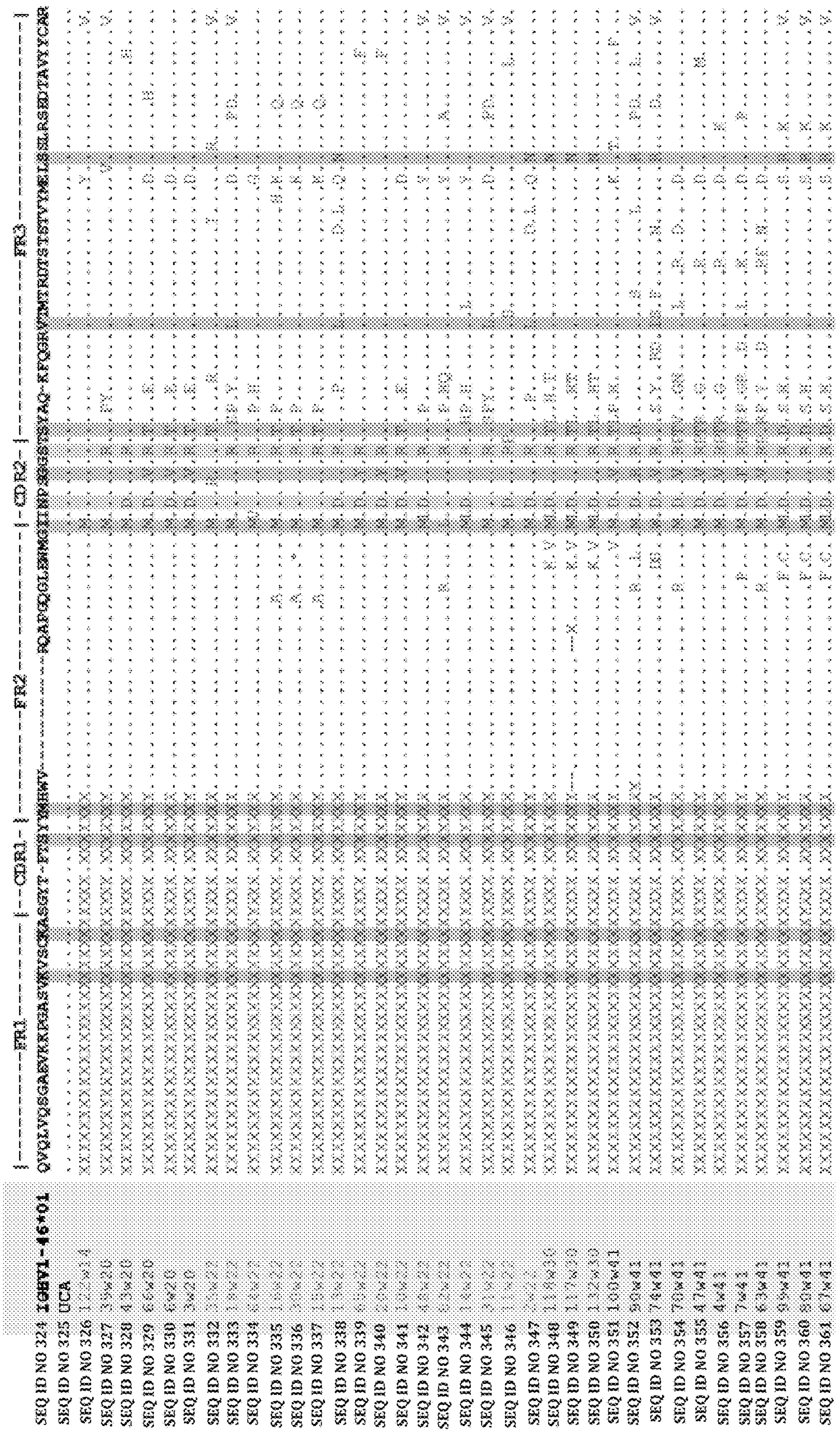
Figure 48A:
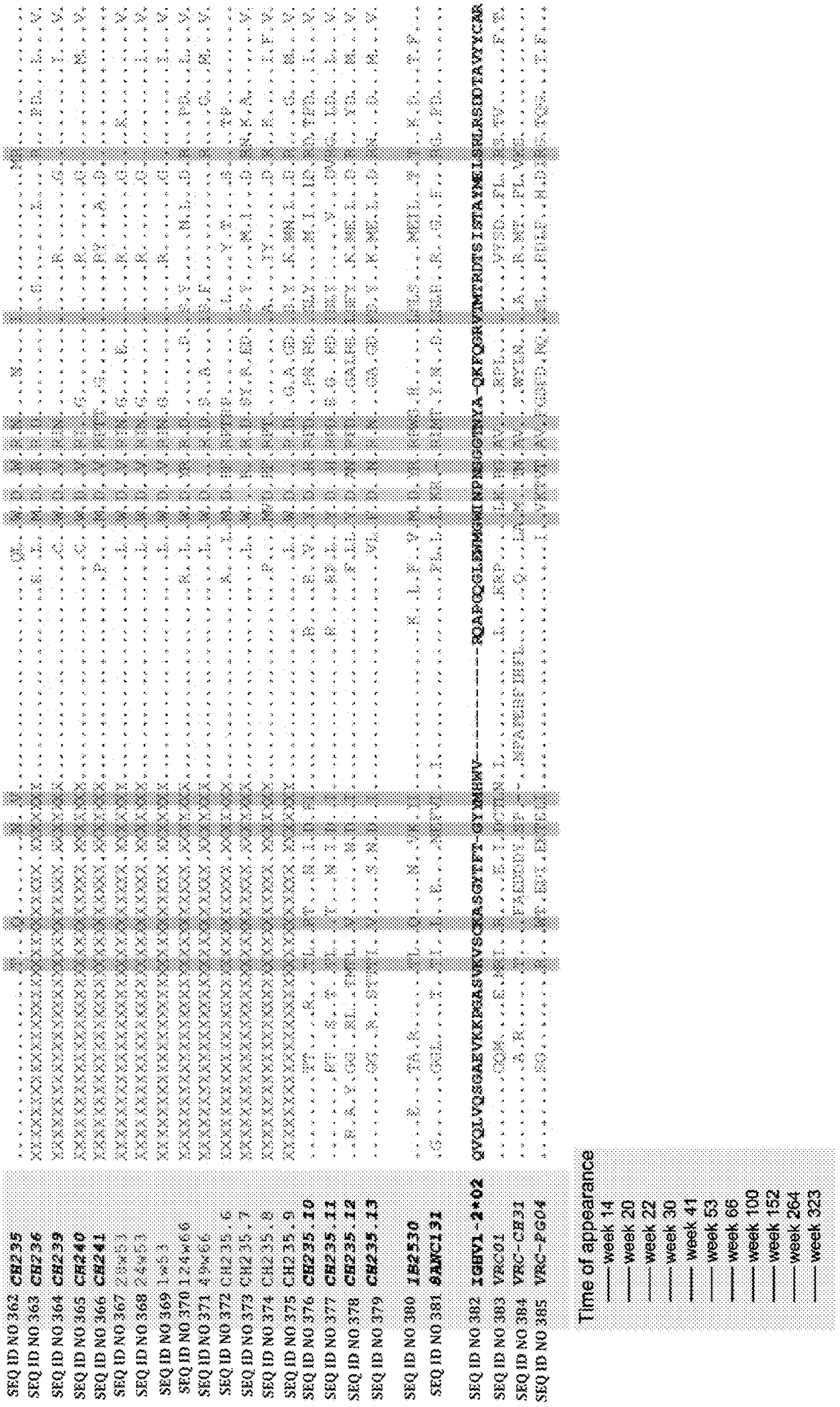
Figure 48B:
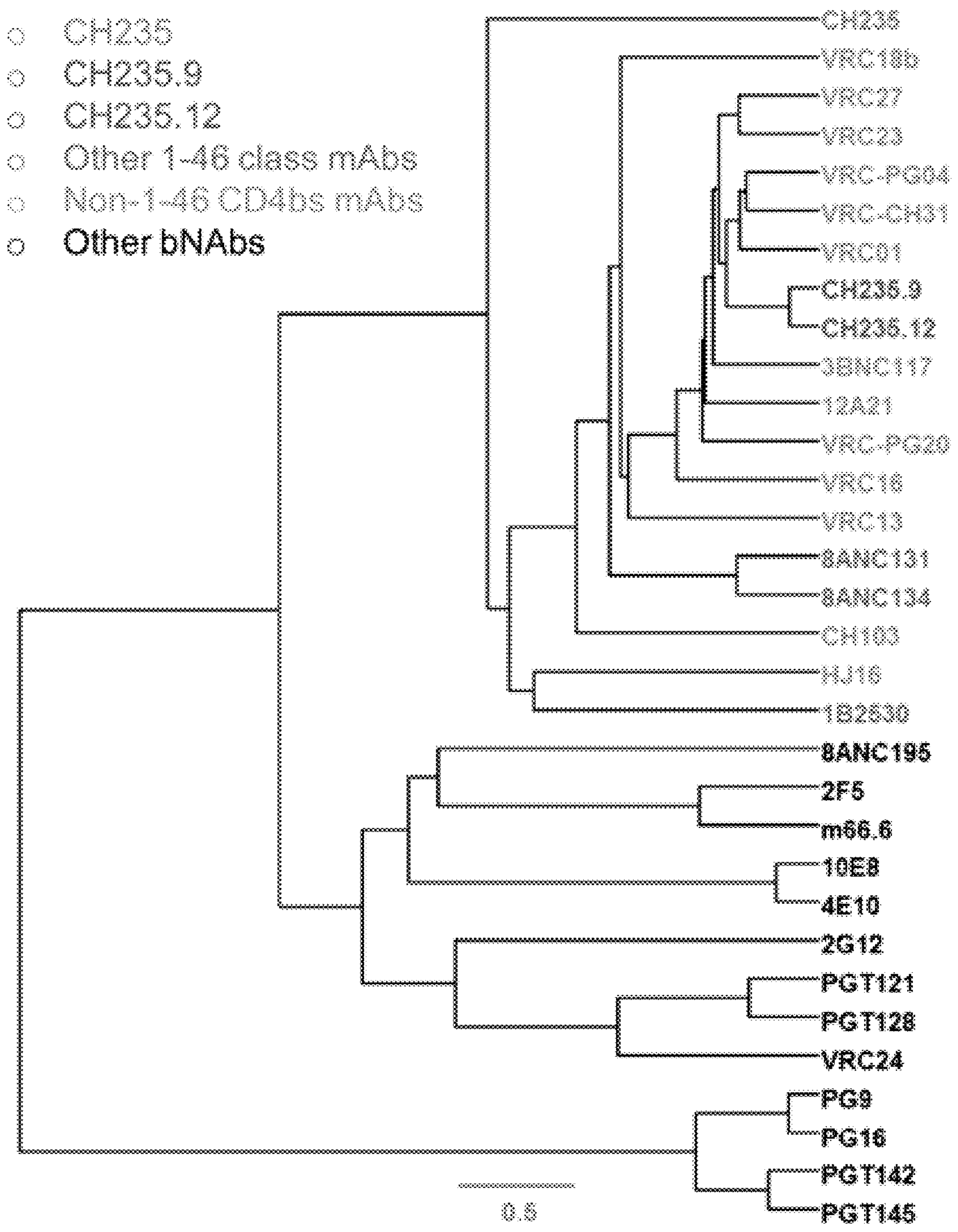

FIGS. 48A-B show CH235 Lineage: Sequences and Neutralization Fingerprint Dendrogram, related to FIGS. 41A-B. (A) Alignment of NGS sequences (SEQ ID NOS 324-385, respectively, in order of appearance) and antibodies isolated from 17 time points from 6 to 323 weeks post-transmission and comparison of mutation patterns to other IGHV1-46 (1B2530 and 8ANC131) and IGHV1-2 (VRC01, VRC-CH31 and VRC-PG04) derived broadly neutralizing antibodies. Antibodies isolated from single B cells are shown in bold. The positions mutated in CH235 were color coded based on the time points at which these mutations were firstly observed in the NGS reads. Mutated positions not seen in the NGS data are colored based on the time of isolation of CH235 (41 weeks). IGHV1-46*01 is used as reference for IGHV1-46 derived antibodies and IGHV1-2*02 is used as reference for the three VRC01-class antibodies. (B) The neutralization fingerprints for three antibodies from the CH235 lineage were compared to the fingerprints for other VH1-46 class antibodies and non-VH1-46 class CD4-binding-site antibodies; coloring same as in FIGS. 43A-C. Antibodies targeting other sites of vulnerability on HIV-1 Env are shown as control (black).

FIGS. 49A-G show CH235 Lineage Versus Other CD4-Binding Site Antibodies and Negative-stain EM Reconstructions of gp140 SOSIP Trimers with CH235-lineage Fabs, related to FIGS. 42A-E. (A) CD4-mimicry by CH235. Recognition of gp120 by the N-terminal domain of the CD4 receptor (far left) is compared to VH genes from CH235 and prototypic antibodies VRC01 (from VH1-2) and 8ANC131 (from VH1-46). (B) Conserved molecular interactions between antibody CH235, receptor CD4 and antibody VRC01. Top row shows intermolecular antiparallel strand interactions and bottom row Asp368 electrostatic interaction. (C) Binding orientation of VH-gene derived antibodies relative to CD4. (D) Negative-stain EM 3D models with BG505 SOSIP.664. (left) Top and side views of CH235.12 in complex with BG505 SOSIP (purple) aligned to the EM volume of VRC01 in complex with BG505 (gold mesh; EMD-6252). (middle) Top and side views of the CH235.12-BG505 complex (purple mesh) aligned to the EM volume of CH103 in complex with BG505 SOSIP (gray; EMD-6250). (right) Top and side views of the CH103-BG505 complex (gray mesh) aligned to the EM reconstruction of BG505 SOSIP in complex with soluble CD4 and 17b Fab (blue; EMDB ID 5723). (E) Negative-stain EM of gp140 SOSIP trimers with CH235-lineage Fabs. (F) Top and side views of 3D reconstructions of each complex. (G) Fourier shell correlation curves for each dataset with a resolution estimate using an FSC cutoff of 0.5.

FIGS. 50A-E shows sequence Similarity Between VH1-2 and VH1-46 Broadly Neutralizing Antibodies and Mutability of Germline Genes, related to FIGS. 43A-C. (A) Amino acid alignment of 8ANC131 (SEQ ID NO: 387) and CH235 (SEQ ID NO: 388) to the IGHV1-46 (SEQ ID NO: 386) germline gene showing the definition of conformity. (B) Probability distribution of the number of sharing mutation positions for each pair of antibodies. (C) Probability distribution of the number of identical mutations for each pair of antibodies. (D) SHM frequency is shown versus VH-gene position for VH1-46, VH1-2 and three others. Sequences were aligned to VH1-46 and positions not aligned to VH1-46 (indels) were removed. (E) Dendrogram showing sequence segregation of VH1-2 and VH1-46 derived broadly neutralizing antibodies, despite similarity of VH1-2 and VH1-46 germline genes shown with underline.

Figure 51A:
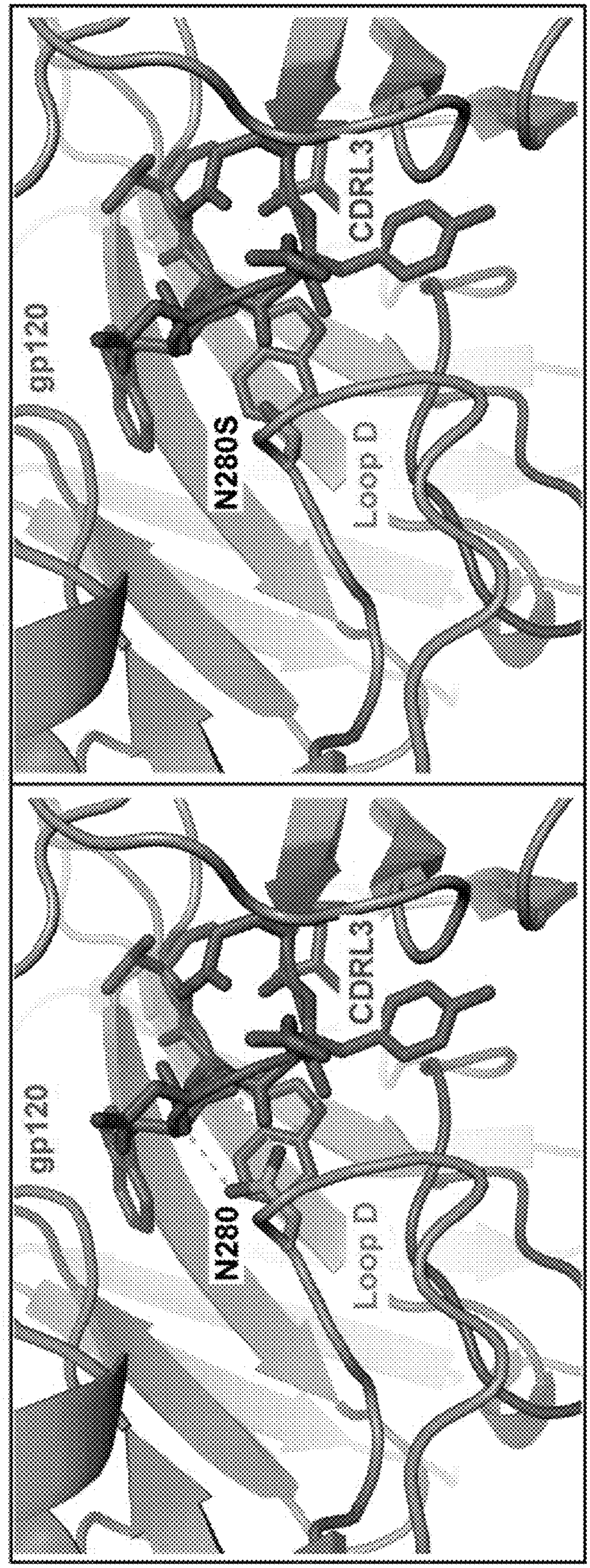

FIGS. 51A-B shows generation of CH235.9 Mutants to Evaluate the Effect of Mutations in the V-heavy Chain on the Ability of CH235.9 to Neutralize loop D Mutant CH505 Autologous Viruses, related to FIGS. 45A-C. (A) The interaction between CH235 CDR L3 (purple) and N280 in the HIV-1 gp120 Env loop D (orange) from the crystal structure of the CH235-gp120 complex (left panel). Asparagine in position 280 in gp120 forms three hydrogen bonds (yellow dotted lines) with residues in the CDR L3 (left panel).

Structural modeling predicted these hydrogen bonds to be disrupted in the N280S (right panel) and N280T (not shown) mutations which occur in autologous CH505 escape mutants. (B) Alignment of CH235.7 and CH235.9 through CH235.13 VH amino acid sequences to CH236 VH. CH235.9 aa mutations expressed as recombinant IgG and tested for neutralization of CH505 TF loop D mutants are shown in red (SEQ ID NOS 389-395, respectively, in order of appearance). Asterisks indicate points of contact with gp120 derived from the CH235 crystal structure in complex with gp120 Env.

Figure 52A:
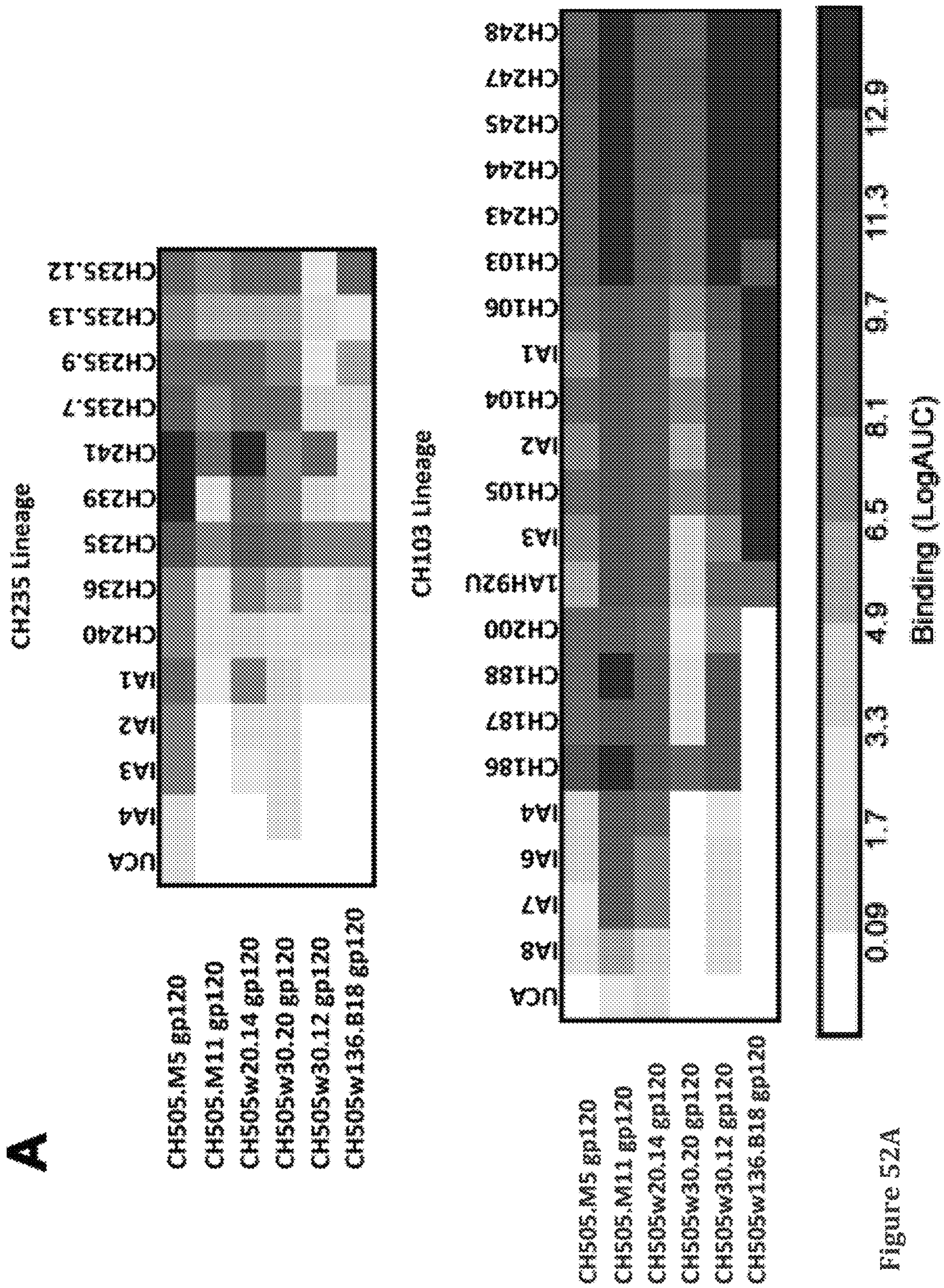
Figure 52B:
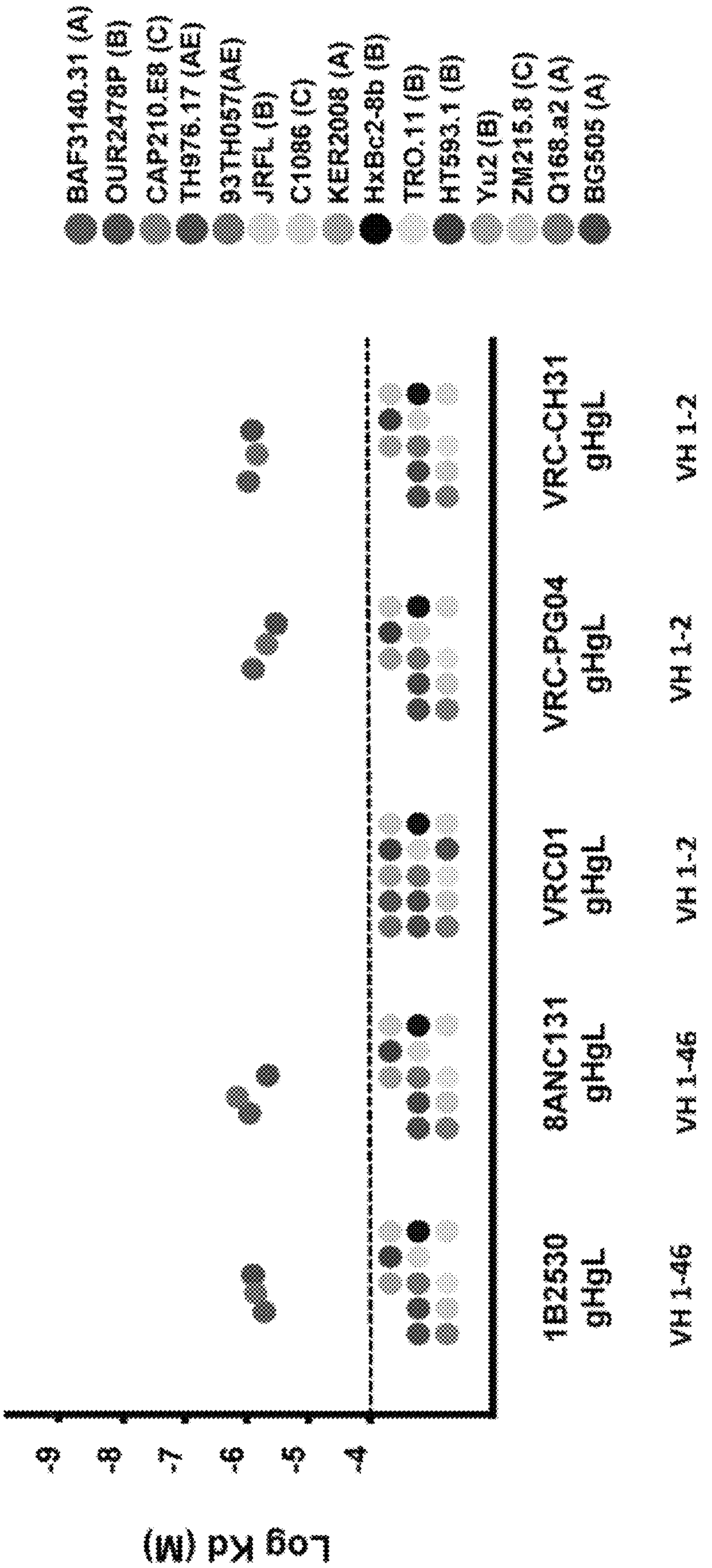

FIGS. 52A-B show CH505 gp120 Env Quasi-species Selected as Optimized Immunogens to Induce Both CH235 and CH103-like bnAbs, related to FIGS. 46A-B. (A) Heatmap of the binding data of selected CH235 and CH103 lineage members to the CH505 Env glycoproteins selected to be used as immunogens. Individual Env clone names and weeks of isolation are shown on the left. (B) Affinity of gHgL of 1B2530, 8ANC131, VRC01, VRC-PG04 and VRC-CH31 to a panel of 15 heterologous gp120 envelope glycoproteins.

FIG. 53 shows characteristics of the V(D)J rearrangements of key CH235 lineage antibodies. Related to FIGS. 41A-B.

FIG. 54 shows a summary of the Breadth and Potency of Antibody Neutralization Against 199 HIV-1 Env-Pseudoviruses. Related to FIGS. 41A-B.

FIG. 55 shows Crystallographic Data Collection and Refinement Statistics. Related to FIGS. 42A-E.

FIGS. 56A-C show sequence Similarity Between VH1-2 and VH1-46 Broadly Neutralizing Antibodies and Mutability of Germline Genes. Related to FIGS. 43A-C. (A) The probability of a conforming VH1-46 antibody with x $V_H$ mutations, having c common mutation positions with a reference antibody were estimated based on 100,000 simulated events, with the likelihood of each residue being mutated based on uniform distribution (position) ($P_{uniform}$), or the mutation frequency at each residue position derived from the VH1-46 antibodies ($P_{VH1\text{-}46}$). (B) The probability of a conforming VH1-46 antibody with x $V_H$ mutations, having i identical mutations with a reference antibody were estimated based on 100,000 simulated events, with the likelihood of each residue being mutated based on uniform distribution (position and mutation type) ($P_{uniform}$), or the mutation frequency at each residue position derived from the VH1-46 antibodies ($P_{VH1\text{-}46}$). (C) Pearson correlation coefficients of positional somatic mutation frequency between VH1-46, VH1-2 and three others.

FIGS. 57A-B show CH235 Lineage and CH106 Monoclonal Antibodies Cross-Blocking. Related to FIGS. 44A-D. (A) CH235 lineage antibodies blocking of sCD4 and CH106 binding to CH505 TF gp120 and B.63521 gp120 Envs. Results expressed as IC50 ug/ml. nb=no blocking. (B) Monoclonal antibody CH106 blocking of CH235 lineage antibodies to CH505 TF gp120. Results expressed as IC50 ug/ml. nb=no blocking.

FIG. 58 shows CH235 lineage autologous neutralization. Related to FIGS. 45A-C.

FIG. 59 shows CH235 lineage antibodies and CH235.9 mutants neutralization of CH505 TF loop D mutant viruses. Related to FIGS. 45A-C.

FIG. 60 shows binding of antibodies in the CH235 and CH103 lineages to CH505 autologous Env glycoproteins, Related to FIGS. 46A-B.

Figure 61:
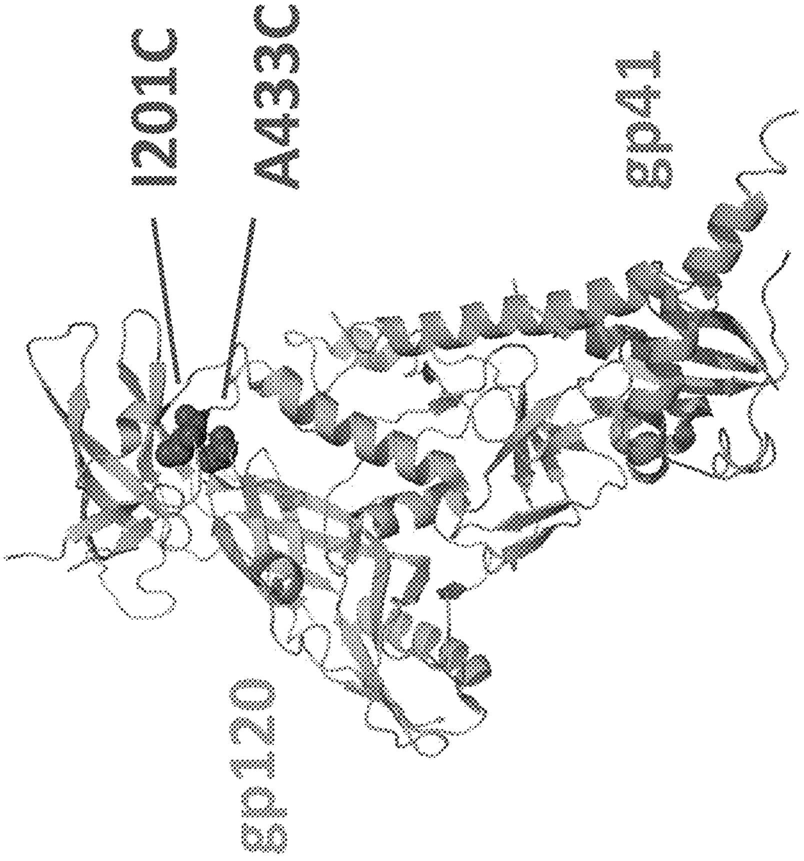

FIG. 61 shows stabilization of chimeric CH505 TF SOSIP gp140. The introduction of a cysteine at positions 201 and 433 formed a disulfide bond that stabilized the trimer in the pre-CD4 bound conformation (Nat Struct Mol Biol. 2015 July; 22(7): 522-531). This mutation was also added to further stabilize the CH505 chimeric SOSIP.

Figure 62:
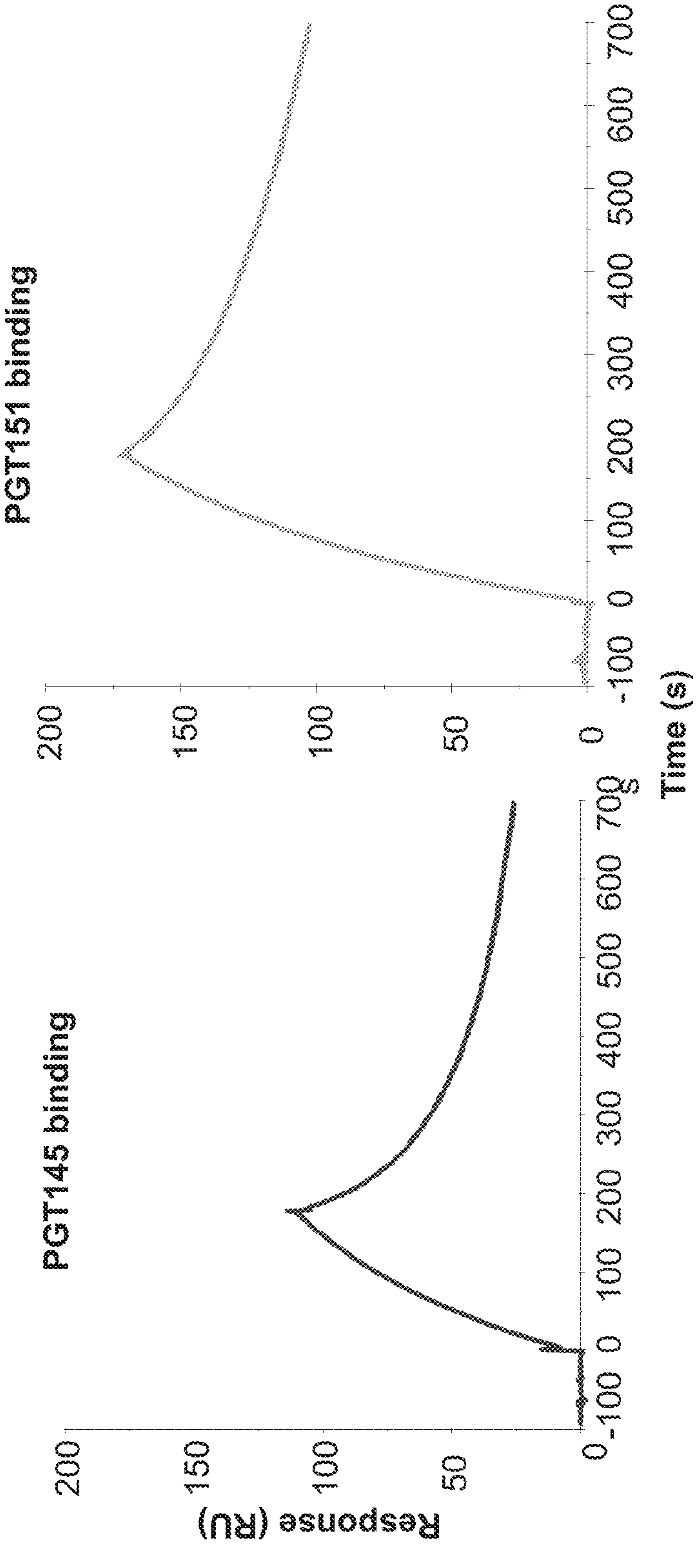

FIG. 62 shows CH505 SOSIP.I binds to trimer-specific bnAbs. The chimeric CH505 TF SOSIP.I was produced and tested for binding to trimer specific bnAbs. In SPR assays, CH505 bound both PGT145 and PGT151.

Figure 63:
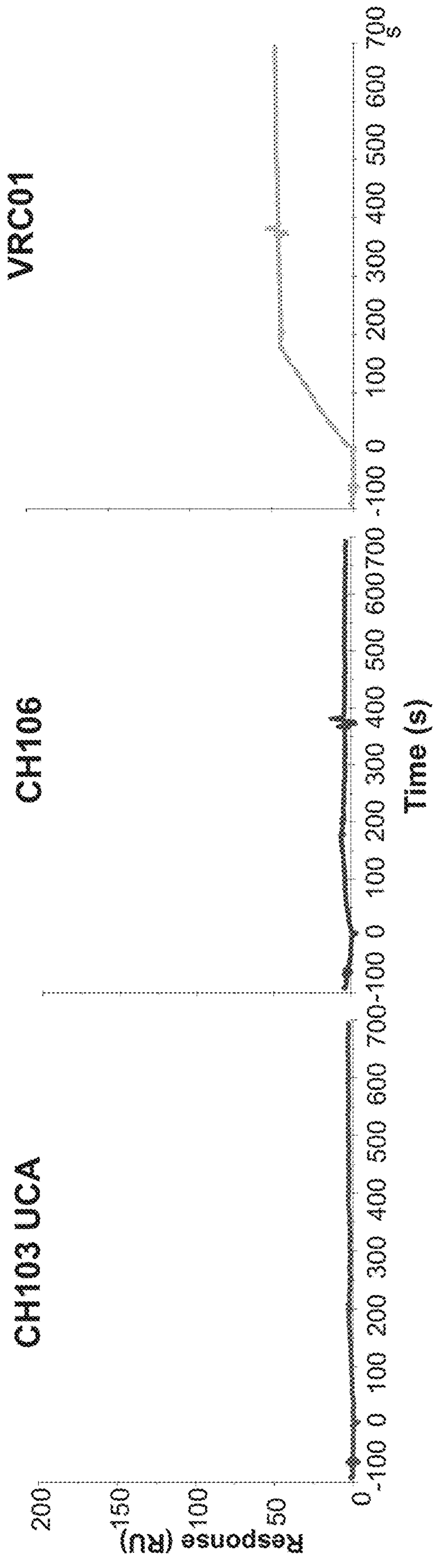

FIG. 63 shows SOSIP.I—stabilization of the trimer to reduce CD4 binding also disrupts binding by the CH103 lineage. When the UCA of the CH103 lineage or a mature bnAb from the lineage CH106 was assessed for binding to the CH505 TF SOSIP.I neither antibody bound to the trimer. In contrast the CD4 mimicking antibody VRC01 was still able to bind.

Figure 64:
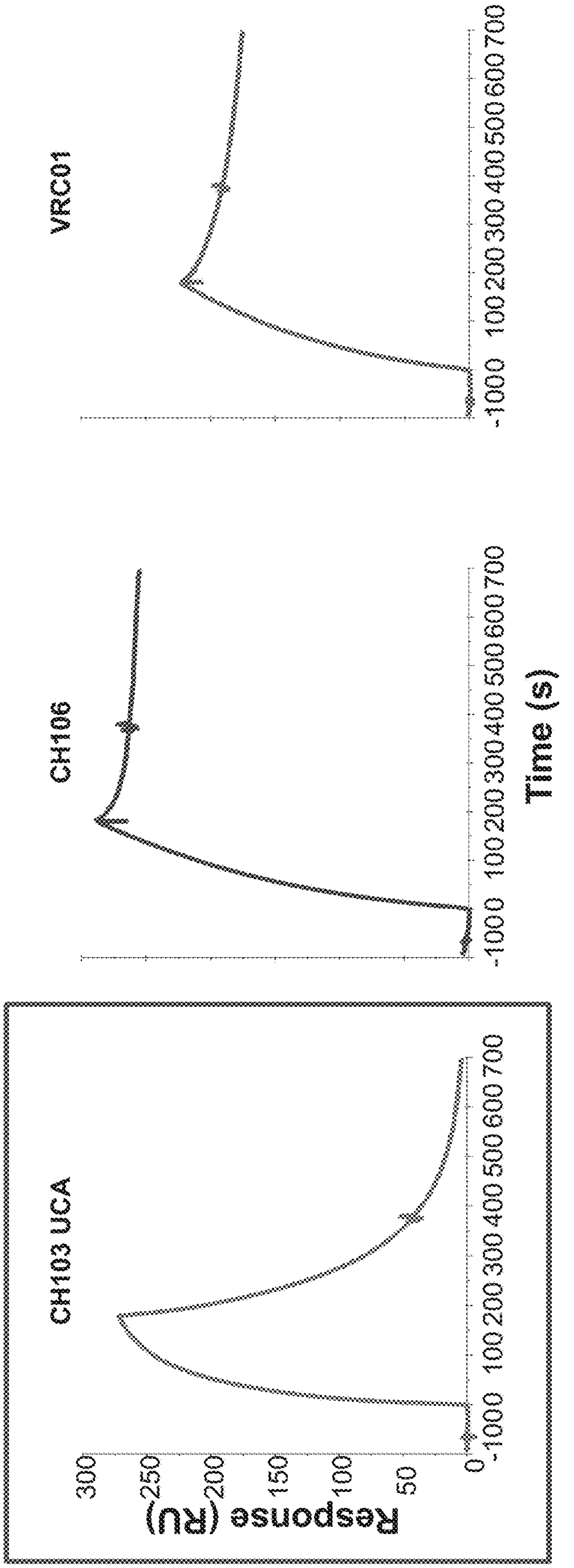

FIG. 64 shows CH103 UCA binds the CH505 transmitted founder gp120. The monomeric CH505 TF gp120 binds to the CH103 UCA by SPR as shown in the box.

Figure 65:
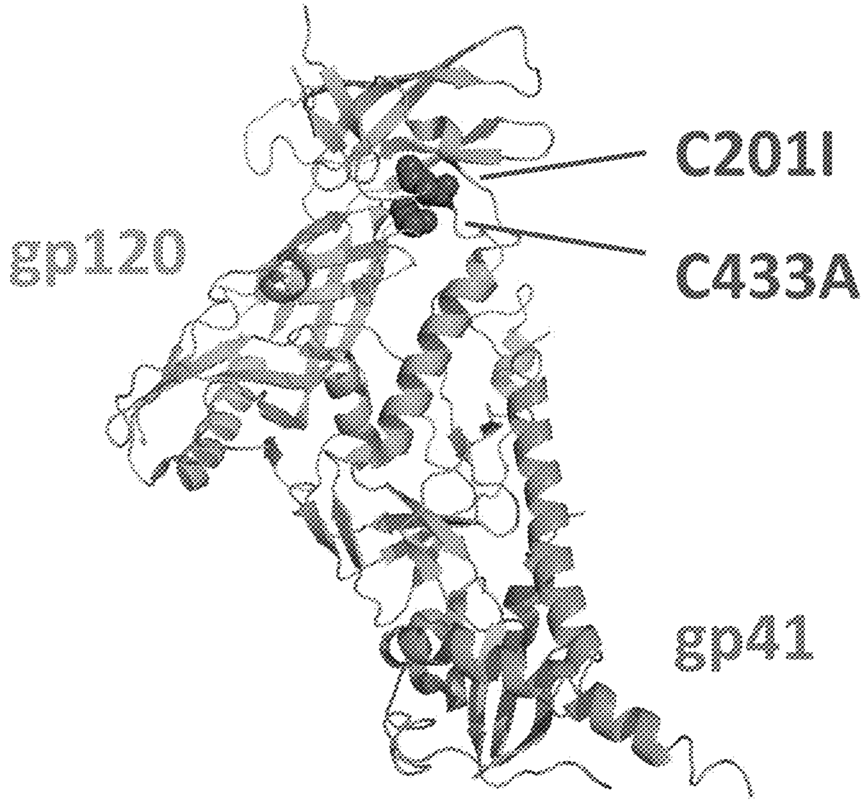

FIG. 65 shows CH505 TF SOSIP.II—removal of the DS mutations to improve CD4bs Ab binding. To test whether the DS stabilizing mutations disrupted CH103 UCA binding, since they were reported to decrease CD4 binding, the cysteine mutations were reverted back to the alanine and isoleucine present in the wildtype virus. The antigenicity of these trimers, called SOSIP.II, was tested.

Figure 66:
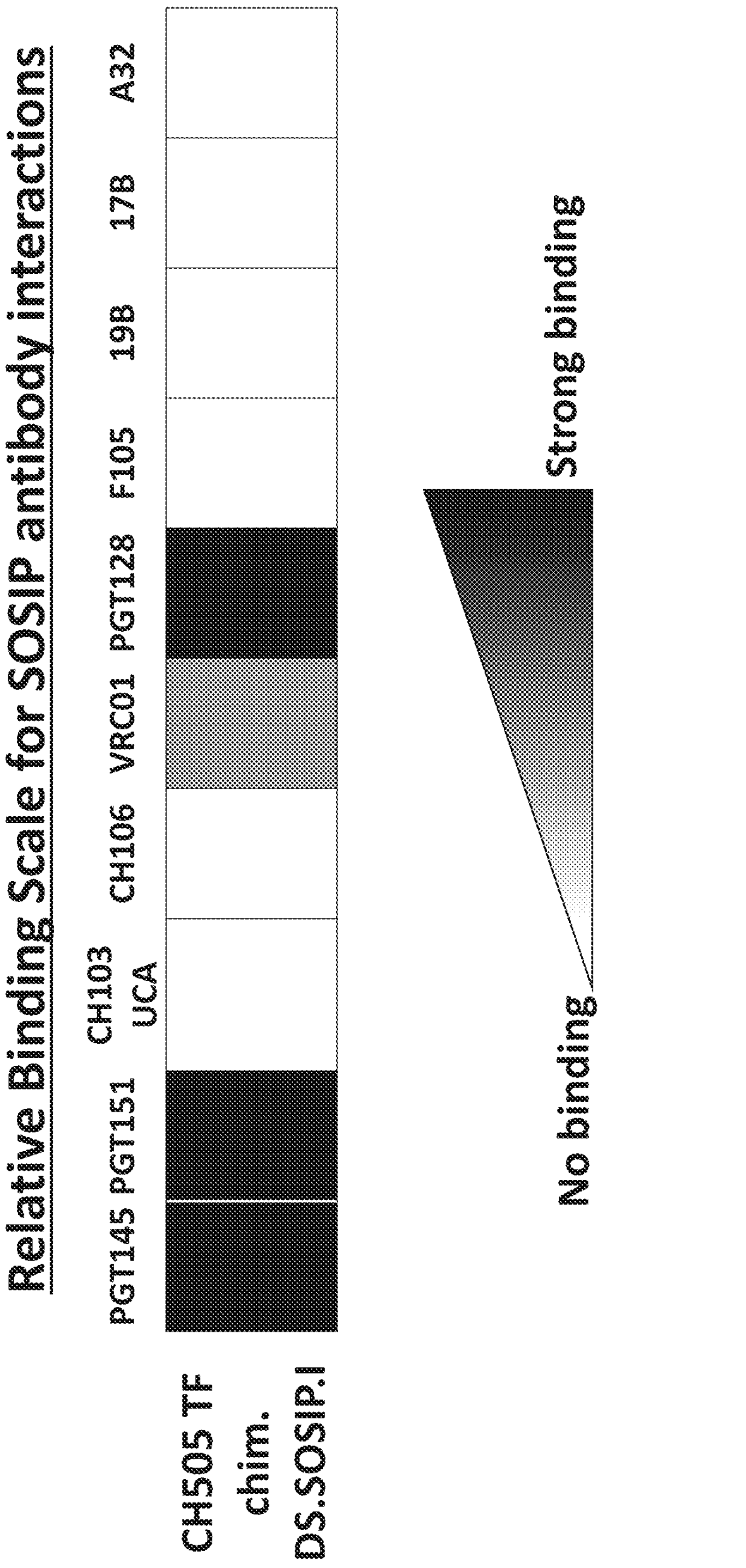
Figure 66:
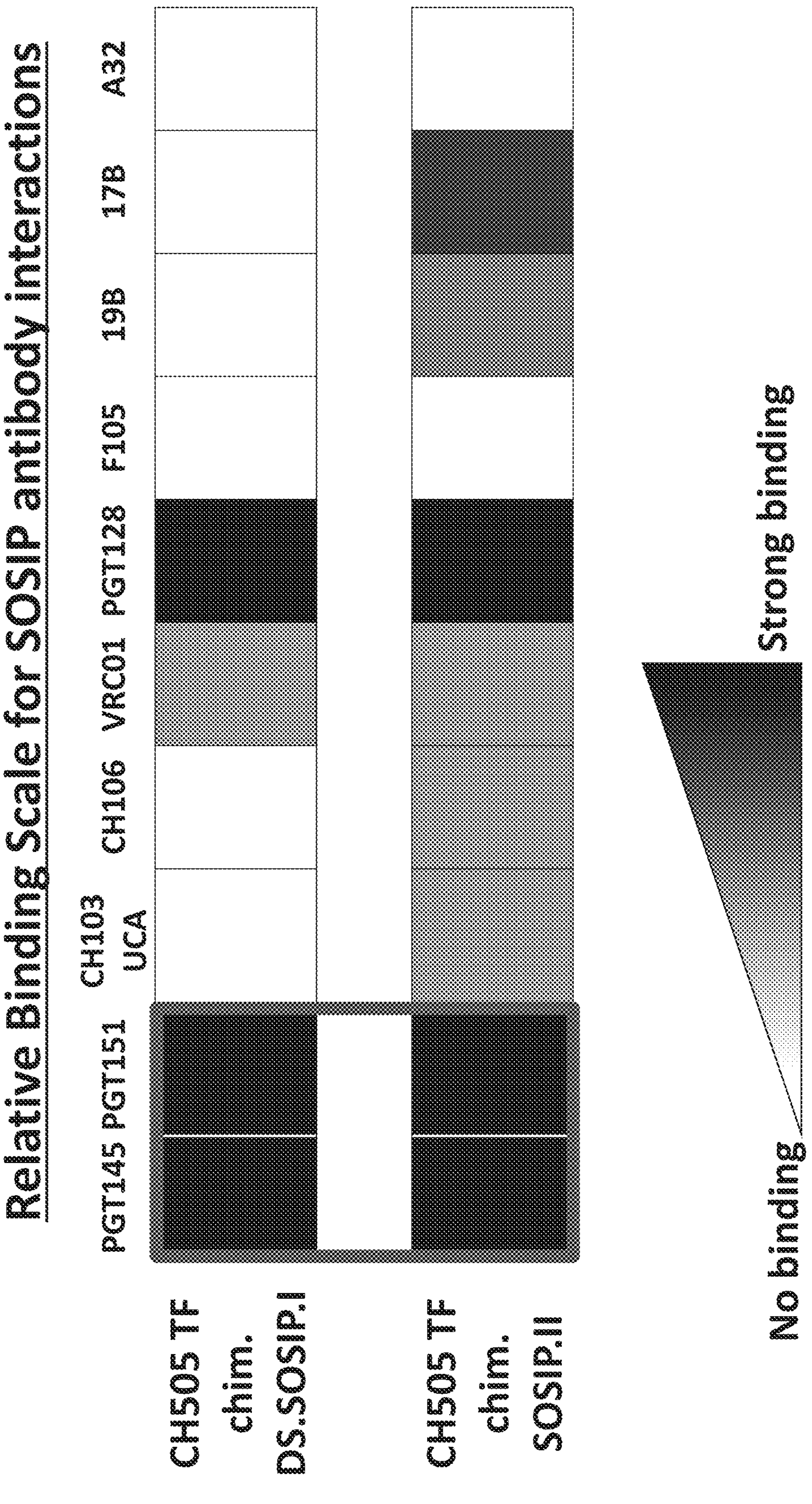
Figure 66:
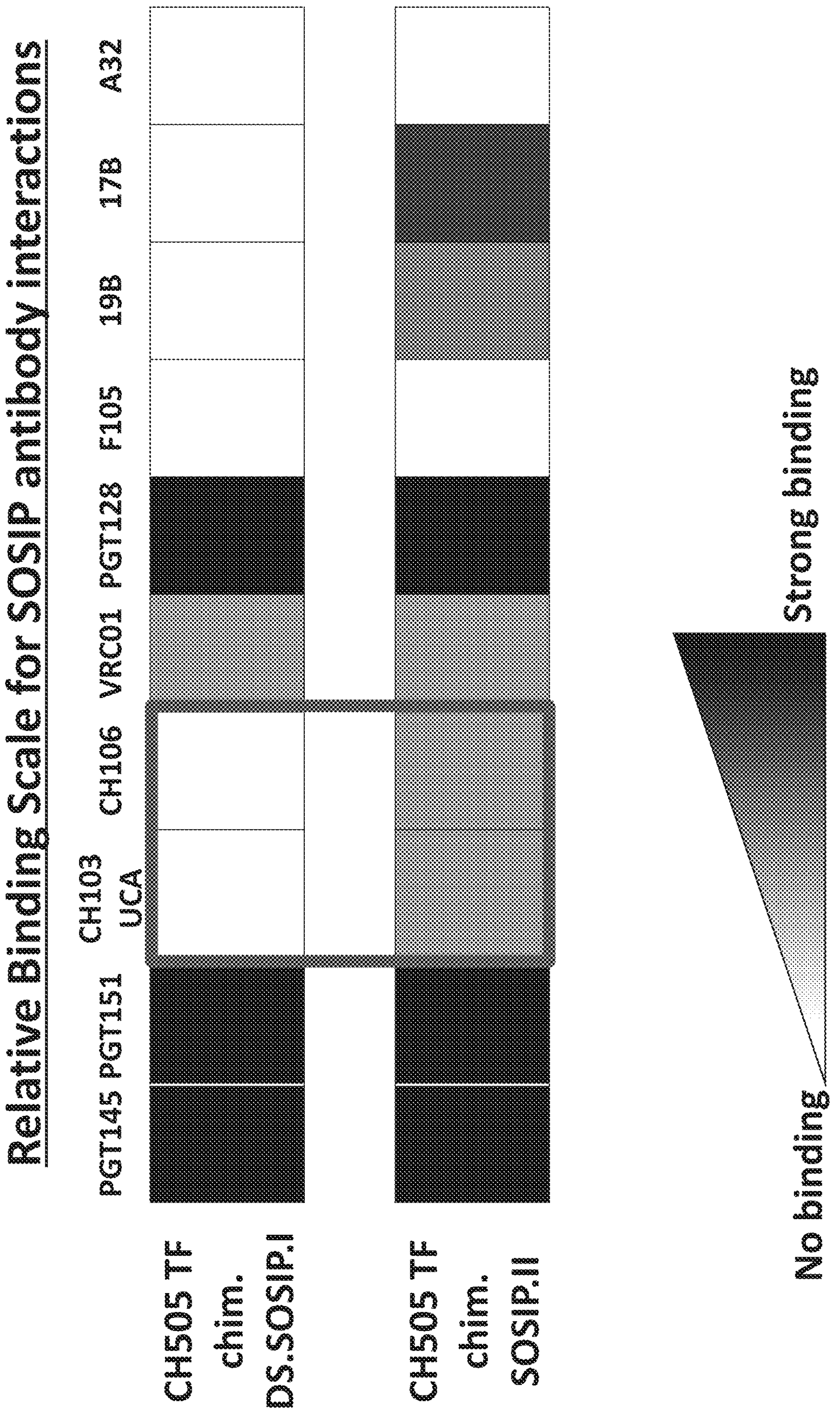
Figure 66:
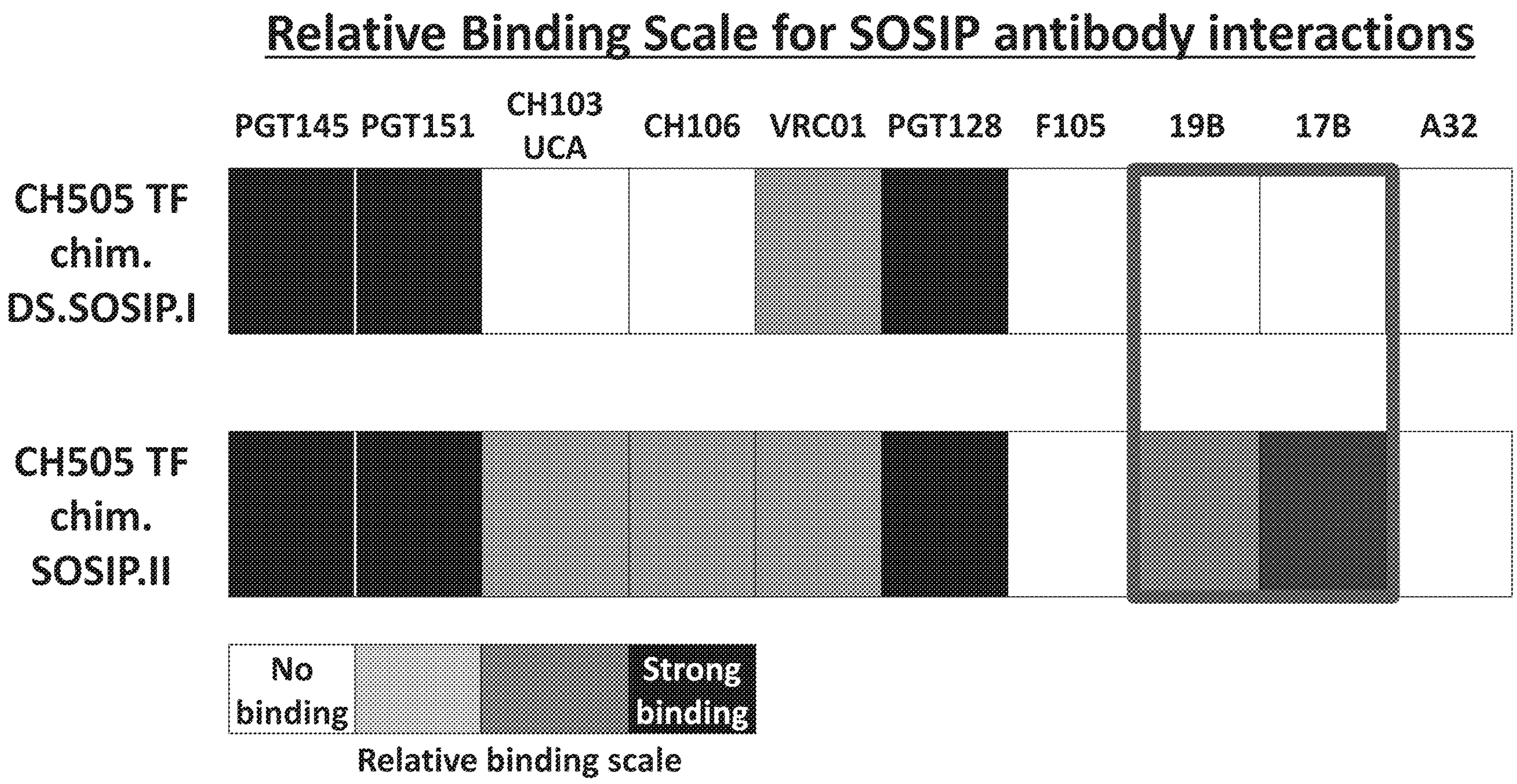

FIG. 66 shows removal of the disulfide stabilizing bond improves UCA binding. A summary of the binding of first SOSIP design called SOSIP.I for comparison to the SOSIP.II proteins is shown. The binding is heat mapped where the darker the color the stronger the binding in BLI experiments. Identical to the first SOSIP design, PGT151 and PGT145 bound to the SOSIP.II design relatively strongly indicating trimer formation. The CH103 lineage antibodies were also able to in bind the SOSIP.II version of the chimeric CH505 trimer. This design still had the V3 loop exposed and at least a portion of the trimers were in a CD4 bound conformation as indicated by 19B and 17B binding.

Figure 67:
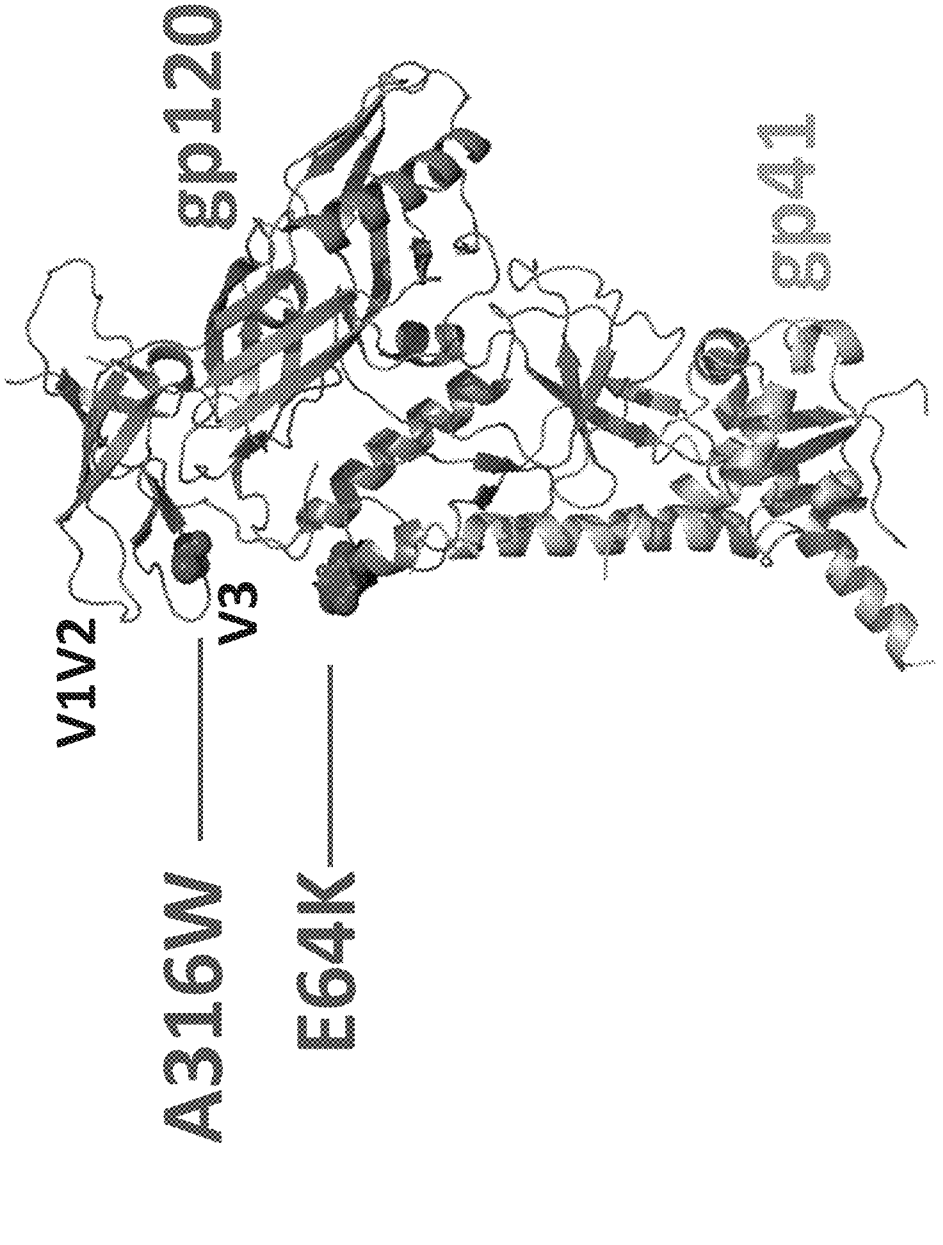

FIG. 67 shows CH505 TF chimeric SOSIP.III—introduction of two stabilizing mutation to reduce V3 exposure. Two mutations that reduced V3 exposure in nonchimeric SOSIPs were tested to see if these mutations could function similarly in the chimeric SOSIP design.

FIG. 68 shows CH505 TF chimeric SOSIP.III forms trimeric envelope and binds the CH103 UCA. The two mutations were introduced and the ability of this protein to form trimers was assessed by PGT151 binding and by negative stain EM. As shown on the left this protein bound to the trimer specific bnAb PGT151, and the protein formed a trimer as shown in the negative stain EM on the right.

Figure 69:
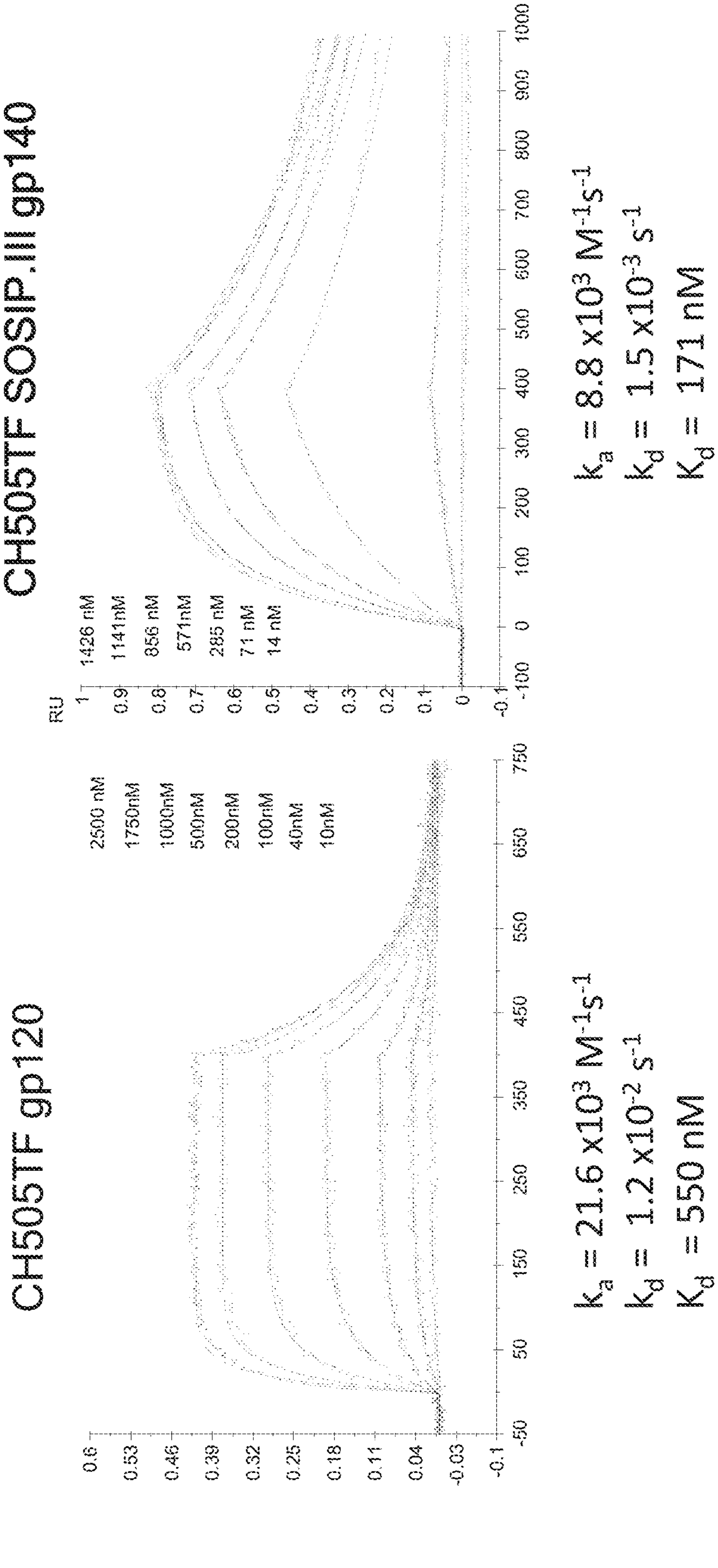

FIG. 69 shows CH103 UCA binds to the CH505 TF SOSIP.III. When binding of the SOSIP.III was assessed and compared to the CH505 TF gp120, it was observed that the off-rate for the CH103 UCA was 10-fold better for the trimer which resulted in an approved affinity for the timer compared to the gp120.

Figure 70:
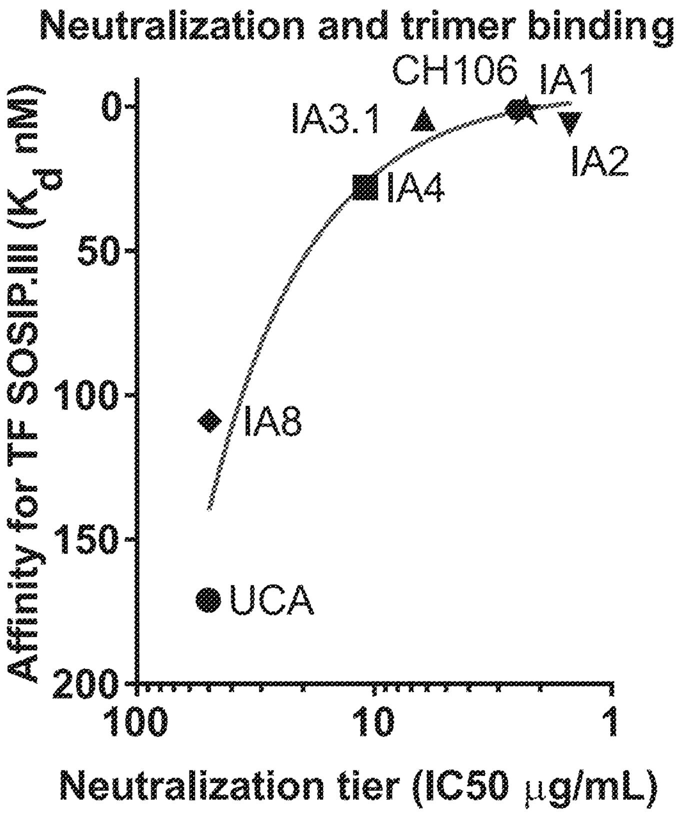

FIG. 70 shows affinity maturation to the TF SOSIPv4.1 correlates with neutralization potency. The binding of the members of the CH103 lineage to the CCH505 TF was assessed. A positive correlation between affinity for the CH505 TF SOSIP.III was found, shown here on the y-axis and bottom row of the table and neutralization potency against the CH505 TF virus shown here on the x-axis and in the table. As antibodies affinity matured and could bind more strongly to the CH505 TF trimer, they also were able to neutralize the CH505 virus more potently.

Figure 71:
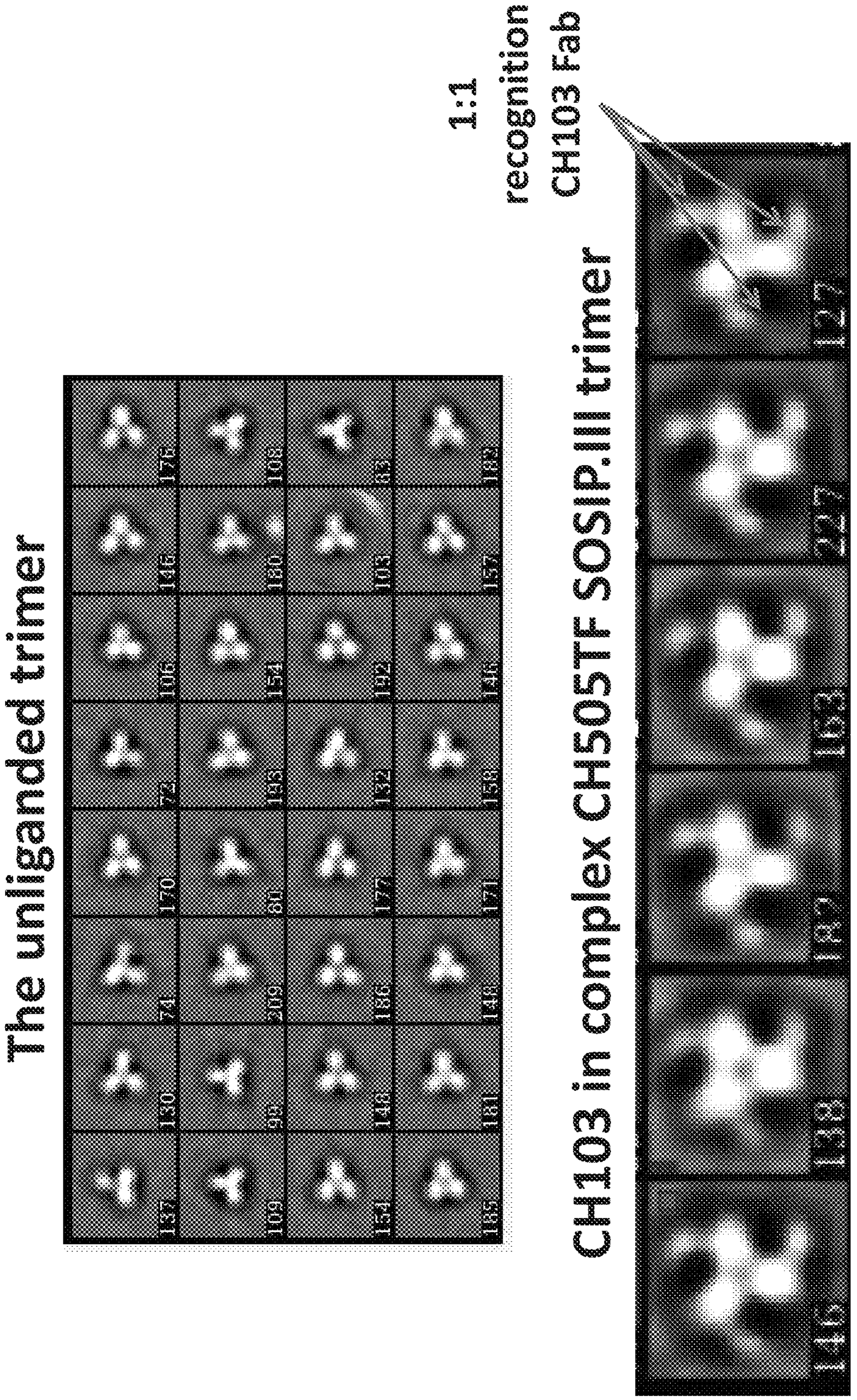

FIG. 71 shows the CH103 mature bnAb engages each protomer of the CH505 TF SOSIP.III. The high affinity of the CH103 mature antibodies for these trimers provided an opportunity to study the stoichiometry of the interaction of the bnAb CH103 and its autologous Envelope. The unliganded trimer formed trimers and upon incubating it with CH103 Fab three CH103 Fabs were observed indicated by the arrows bound to each trimer. Thus the CH103 and gp140 had a 1 to 1 ratio for binding.

Figure 72:
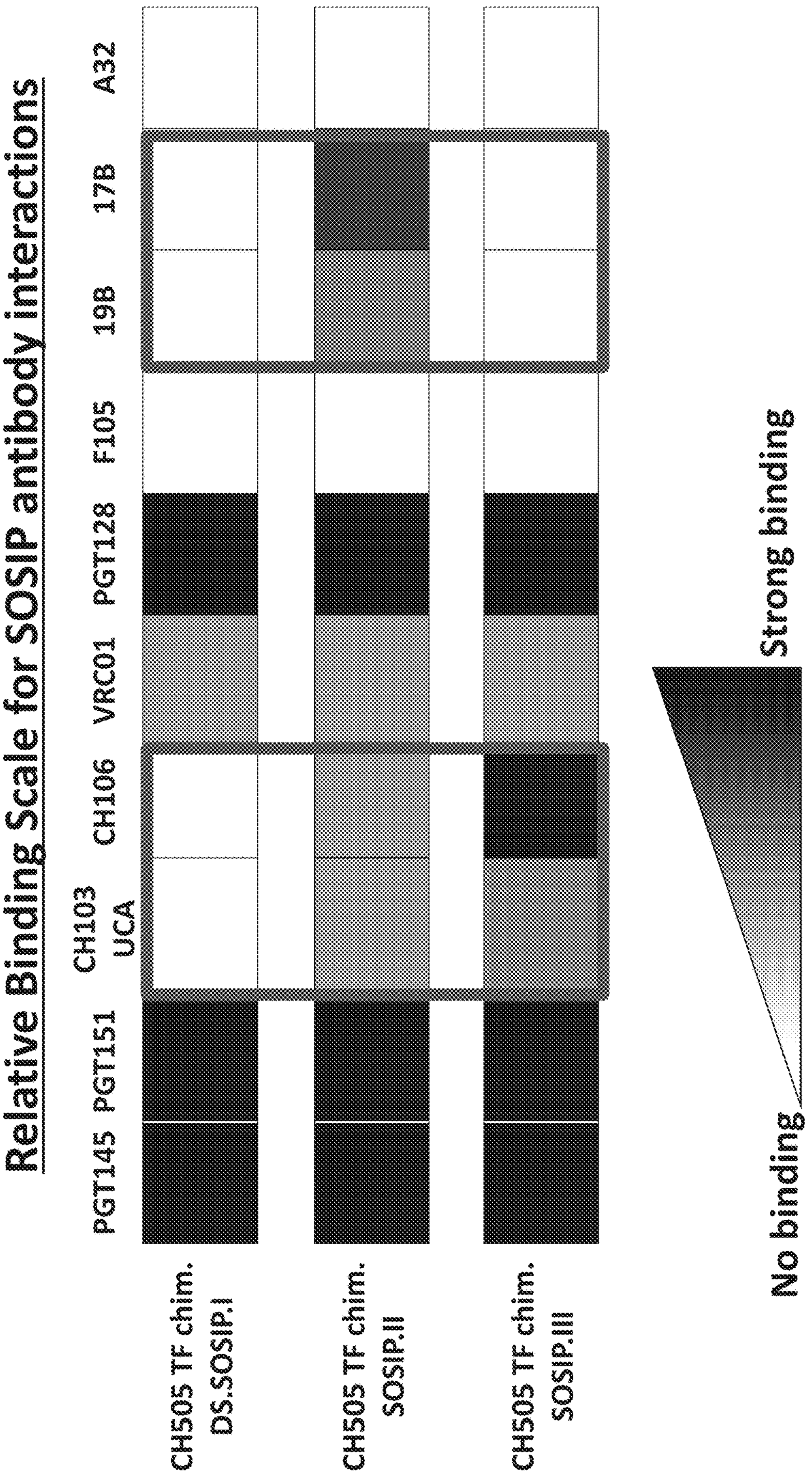

FIG. 72 shows rational design to improve the antigenicity of CH505 TF trimers. The SOSIP.III had the desired antigenicity for the CH103 lineage of antibodies. Its antigenicity on a larger panel of bnAbs was assessed. It bound to bnAbs but unlike the SOSIP.II it did not bind to 19B or 17B.

Figure 73:
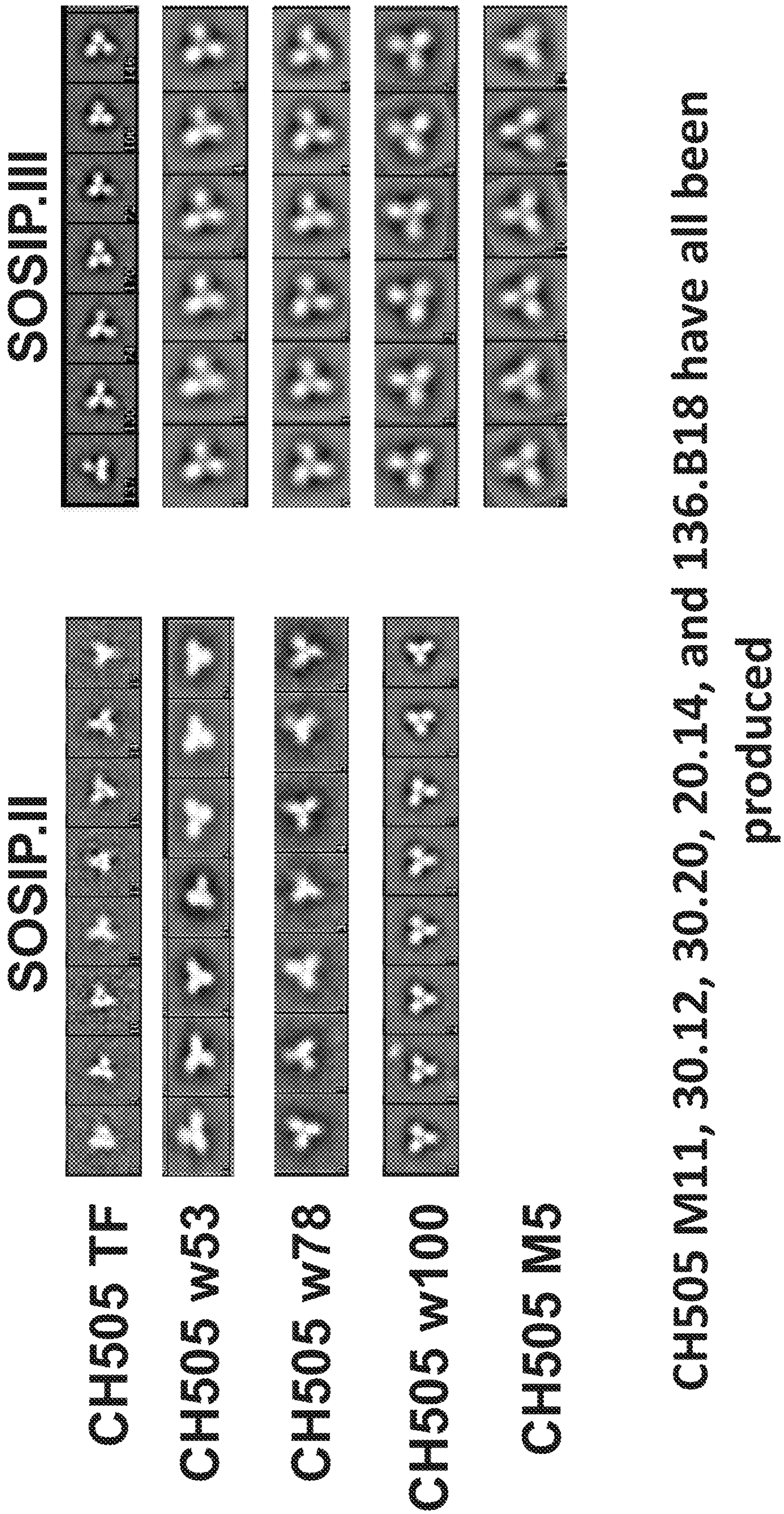

FIG. 73 shows CH505 Envs from sequential viruses form stable trimers as chimeric SOSIP.II and III.

This approach has been employed to multiple CH505 Env sequences in order to make sequential vaccination regimens. A 4-valent vaccination regimen of SOSIP.II was made. The same 4-valent vaccine was made using the SOSIP.III design. A 6-valent vaccine can be made. Trimers to were analyzed for glycosylation and disulfide bond analysis and the Envs have the expected glycosylation and lack aberrant disulfide bonds.

Figure 74:
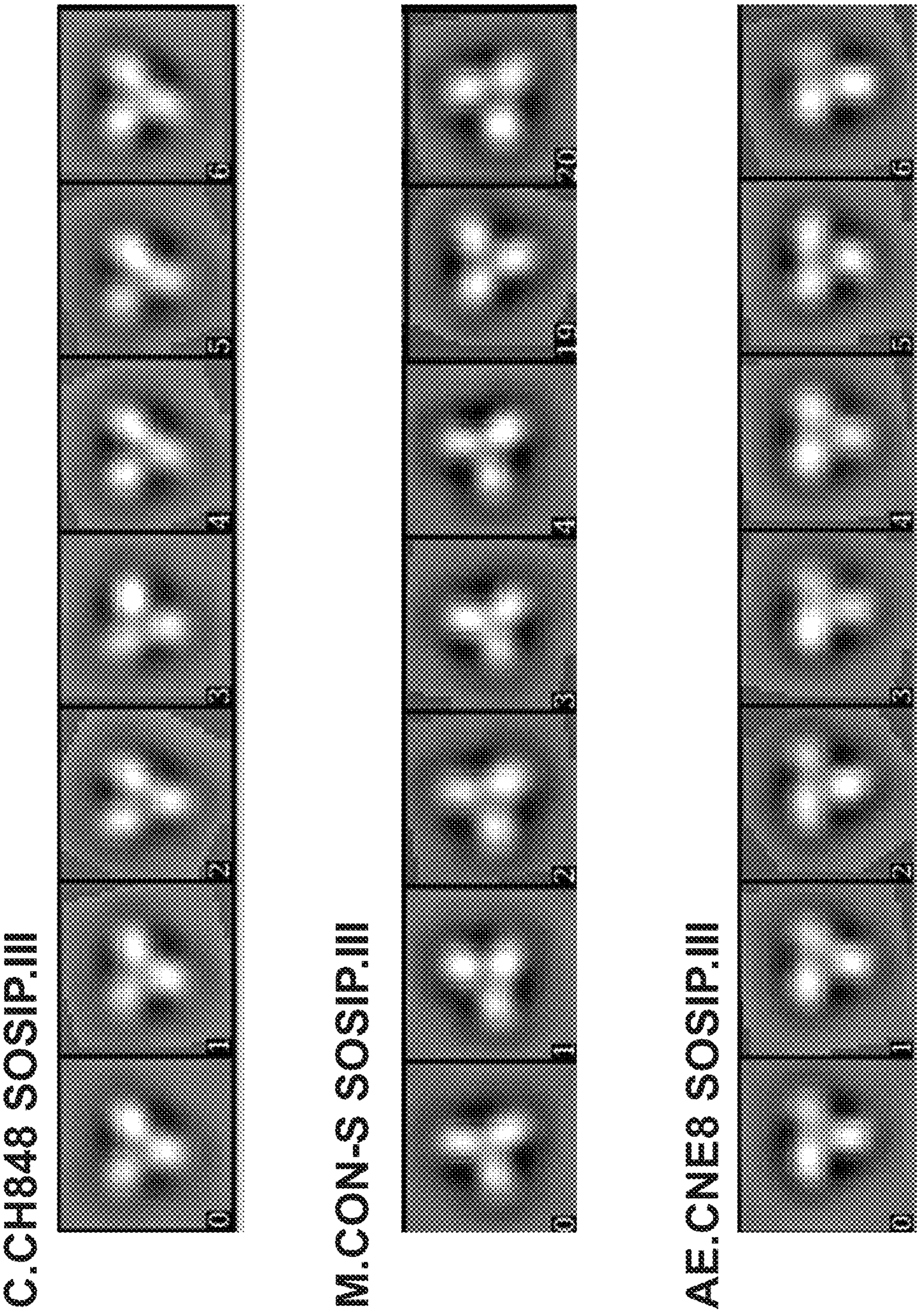

FIG. 74 shows the chimeric SOSIP.III design is applicable to diverse viruses. This design can be extrapolated to Envs that are not from the CH505 infected individual. Envs from clade C or AE or a group M consensus have all been used and form stable trimers using this design. This highlights the general applicability of this trimer design.

DETAILED DESCRIPTION OF THE INVENTION

The development of a safe, highly efficacious prophylactic HIV-1 vaccine is of paramount importance for the control and prevention of HIV-1 infection. A major goal of HIV-1 vaccine development is the induction of broadly neutralizing antibodies (bnAbs) (Immunol. Rev. 254: 225-244, 2013). BnAbs are protective in rhesus macaques against SHIV challenge, but as yet, are not induced by current vaccines.

For the past 25 years, the HIV vaccine development field has used single or prime boost heterologous Envs as immunogens, but to date has not found a regimen to induce high levels of bnAbs.

Recently, a new paradigm for design of strategies for induction of broadly neutralizing antibodies was introduced, that of B cell lineage immunogen design (Nature Biotech. 30: 423, 2012) in which the induction of bnAb lineages is recreated. It was recently demonstrated the power of mapping the co-evolution of bnAbs and founder virus for elucidating the Env evolution pathways that lead to bnAb induction (Nature 496: 469, 2013). From this type of work has come the hypothesis that bnAb induction will require a selection of antigens to recreate the "swarms" of sequentially evolved viruses that occur in the setting of bnAb generation in vivo in HIV infection (Nature 496: 469, 2013).

A critical question is why the CH505 immunogens are better than other immunogens. This rationale comes from three recent observations. First, a series of immunizations of single putatively "optimized" or "native" trimers when used as an immunogen have not induced bnAbs as single immunogens. Second, in all the chronically infected individuals who do develop bnAbs, they develop them in plasma after ~2 years. When these individuals have been studied at the time soon after transmission, they do not make bnAbs immediately. Third, now that individual's virus and bnAb co-evolution has been mapped from the time of transmission to the development of bnAbs, the identification of the specific Envs that lead to bnAb development have been identified-thus taking the guess work out of envelope choice.

Two other considerations are important. The first is that for the CH103 bnAb CD4 binding site lineage, the VH4-59 and Vλ3-1 genes are common as are the VDJ, VJ recombinations of the lineage (Liao, Nature 496: 469, 2013). In addition, the bnAb sites are so unusual, we are finding that the same VH and VL usage is recurring in multiple individuals. Thus, we can expect the CH505 Envs to induce CD4 binding site antibodies in many different individuals.

Regarding the choice of gp120 vs. gp160, for the genetic immunization we would normally not even consider not using gp160. However, in acute infection, gp41 non-neutralizing antibodies are dominant and overwhelm gp120 responses (Tomaras, G et al. J. Virol. 82: 12449, 2008; Liao, H X et al. JEM 208: 2237, 2011). Recently we have found that the HVTN 505 DNA prime, rAd5 vaccine trial that utilized gp140 as an immunogen, also had the dominant response of non-neutralizing gp41 antibodies. Thus, we will evaluate early on the use of gp160 vs gp120 for gp41 dominance.

In certain aspects the invention provides a strategy for induction of bnAbs is to select and develop immunogens and combinations designed to recreate the antigenic evolution of Envs that occur when bnAbs do develop in the context of infection.

That broadly neutralizing antibodies (bnAbs) occur in nearly all sera from chronically infected HIV-1 subjects suggests anyone can develop some bnAb response if exposed to immunogens via vaccination. Working back from mature bnAbs through intermediates enabled understanding their development from the unmutated ancestor, and showed that antigenic diversity preceded the development of population breadth. See Liao et al. (2013) Nature 496, 469-476. In this study, an individual "CH505" was followed from HIV-1 transmission to development of broadly neutralizing antibodies. This individual developed antibodies targeted to CD4 binding site on gp120. In this individual the virus was sequenced over time, and broadly neutralizing antibody clonal lineage ("CH103") was isolated by antigen-specific B cell sorts, memory B cell culture, and amplified by VH/VL next generation pyrosequencing. The CH103 lineage began by binding the T/F virus, autologous neutralization evolved through somatic mutation and affinity maturation, escape from neutralization drove rapid (clearly by 20 weeks) accumulation of variation in the epitope, antibody breadth followed this viral diversification.

Further analysis of envelopes and antibodies from the CH505 individual indicated that a non-CH103 Lineage (DH235) participates in driving CH103-BnAb induction. See Gao et al. (2014) *Cell* 158:481-491. For example V1 loop, V5 loop and CD4 binding site loop mutations escape from CH103 and are driven by CH103 lineage. Loop D mutations enhanced neutralization by CH103 lineage and are driven by another lineage. Transmitted/founder Env, or another early envelope for example W004.26, triggers naïve B cell with CH103 Unmutated Common Ancestor (UCA) which develop in to intermediate antibodies. Transmitted/founder Env, or another early envelope for example W004.26, also triggers non-CH103 autologous neutralizing Abs that drive loop D mutations in Env that have enhanced binding to intermediate and mature CH103 antibodies and drive remainder of the lineage. In certain embodiments, the inventive composition and methods also comprise loop D mutant envelopes (e.g. but not limited to M10, M11, M19, M20, M21, M5, M6, M7, M8, M9) as immunogens. In certain embodiments, the D-loop mutants are included in an inventive composition used to induce an immune response in a subject. In certain embodiments, the D-loop mutants are included in a composition used as a prime.

The invention provides various methods to choose a subset of viral variants, including but not limited to envelopes, to investigate the role of antigenic diversity in serial samples. In other aspects, the invention provides compositions comprising viral variants, for example but not limited to envelopes, selected based on various criteria as described herein to be used as immunogens. In some embodiments, the immunogens are selected based on the envelope binding to the UCA, and/or intermediate antibodies. In some embodiments the immunogens are selected based on their chronological appearance and/or sequence diversity during infection.

In other aspects, the invention provides immunization strategies using the selections of immunogens to induce cross-reactive neutralizing antibodies. In certain aspects, the immunization strategies as described herein are referred to as "swarm" immunizations to reflect that multiple envelopes are used to induce immune responses. The multiple envelopes in a swarm could be combined in various immunization protocols of priming and boosting. Immune responses, including B cell and T cell responses, could be measured by any suitable assay and criteria, such as but non limited plasma neutralization, plasma binding to vaccine and/or heterologous envelopes and/or viruses could be measured.

In certain embodiments the invention provides that sites losing the ancestral, transmitted-founder (T/F) state are most likely under positive selection. From acute, homogenous infections with 3-5 years of follow-up, identified herein are sites of interest among plasma single genome analysis (SGA) Envs by comparing the proportion of sequences per time-point in the T/F state with a threshold, typically 5%. Sites with T/F frequencies below threshold are putative escapes. We then selected clones with representative escape mutations. Where more information was available, such as tree-corrected neutralization signatures and antibody contacts from co-crystal structure, additional sites of interest were considered.

Co-evolution of a broadly neutralizing HIV-1 antibody (CH103) and founder virus was previously reported in African donor (CH505). See Liao et al. (2013) Nature 496, 469-476. In CH505, which had an early antibody that bound autologous T/F virus, we studied 398 envs from 14 time-points over three years (median per sample: 25, range: 18-53). We found 36 sites with T/F frequencies under 20% in any sample. Neutralization and structure data identified 28 and 22 interesting sites, respectively. Together, six gp41 and 53 gp120 sites were identified, plus six V1 or V5 insertions not in HXB2.

The invention provides an approach to select reagents for neutralization assays and subsequently investigate affinity maturation, autologous neutralization, and the transition to heterologous neutralization and breadth. Given the sustained coevolution of immunity and escape this antigen selection based on antibody and antigen coevolution has specific implications for selection of immunogens for vaccine design.

In one embodiment, five envelopes were selected that represent envelope antigenic diversity. In another embodiment, six envelopes were selected that represent envelope antigenic diversity. In another embodiment, ten envelopes were selected that represent envelope antigenic diversity. These sets of envelopes represent antigenic diversity by deliberate inclusion of polymorphisms that result from immune selection by neutralizing antibodies. These selections represent various levels of antigenic diversity in the HIV-1 envelope. In some embodiments the selections are based on the genetic diversity of longitudinally sampled SGA envelopes. In some embodiments the selections are based on antigenic and or neutralization diversity. In some embodiments the selections are based on the genetic diversity of longitudinally sampled SGA envelopes, and correlated with other factors such as antigenic/neutralization diversity, and antibody coevolution.

Sequences/Clones

Described herein are nucleic and amino acids sequences of HIV-1 envelopes. The sequences for use as immunogens are in any suitable form. In certain embodiments, the described HIV-1 envelope sequences are gp160s. In certain embodiments, the described HIV-1 envelope sequences are gp120s. Other sequences, for example but not limited to stable SOSIP trimer designs, gp145s, gp140s, both cleaved and uncleaved, gp140 Envs with the deletion of the cleavage (C) site, fusion (F) and immunodominant (I) region in gp41—named as gp140ΔCFI (gp140CFI), gp140 Envs with the deletion of only the cleavage (C) site and fusion (F) domain—named as gp140ΔCF (gp140CF), gp140 Envs with the deletion of only the cleavage (C)—named gp140AC (gp140C) (See e.g. Liao et al. Virology 2006, 353, 268-282), gp150s, gp41s, which are readily derived from the nucleic acid and amino acid gp160 sequences. In certain embodiments the nucleic acid sequences are codon optimized for optimal expression in a host cell, for example a mammalian cell, a rBCG cell or any other suitable expression system.

An HIV-1 envelope has various structurally defined fragments/forms: gp160; gp140—including cleaved gp140 and uncleaved gp140 (gp140C), gp140CF, or gp140CFI; gp120 and gp41. A skilled artisan appreciates that these fragments/forms are defined not necessarily by their crystal structure, but by their design and bounds within the full length of the gp160 envelope. While the specific consecutive amino acid sequences of envelopes from different strains are different, the bounds and design of these forms are well known and characterized in the art.

For example, it is well known in the art that during its transport to the cell surface, the gp160 polypeptide is processed and proteolytically cleaved to gp120 and gp41 proteins. Cleavages of gp160 to gp120 and gp41 occurs at a conserved cleavage site "REKR." (SEQ ID NO: 1) See Chakrabarti et al. Journal of Virology vol. 76, pp. 5357-5368 (2002) see for example FIG. 1, and Second paragraph in the Introduction on p. 5357; Binley et al. Journal of Virology vol. 76, pp. 2606-2616 (2002) for example at Abstract; Gao et al. Journal of Virology vol. 79, pp. 1154-1163 (2005); Liao et al. Virology vol. 353(2): 268-282 (2006).

The role of the furin cleavage site was well understood both in terms of improving cleave efficiency, see Binley et al. supra, and eliminating cleavage, see Bosch and Pawlita, Virology 64 (5):2337-2344 (1990); Guo et al. Virology 174: 217-224 (1990); McCune et al. Cell 53:55-67 (1988); Liao et al. J Virol. April; 87(8):4185-201 (2013).

Likewise, the design of gp140 envelope forms is also well known in the art, along with the various specific changes which give rise to the gp140C (uncleaved envelope), gp140CF and gp140CFI forms. Envelope gp140 forms are designed by introducing a stop codon within the gp41 sequence. See Chakrabarti et al. at FIG. 1.

Envelope gp140C refers to a gp140 HIV-1 envelope design with a functional deletion of the cleavage (C) site, so that the gp140 envelope is not cleaved at the furin cleavage site. The specification describes cleaved and uncleaved forms, and various furin cleavage site modifications that prevent envelope cleavage are known in the art. In some embodiments of the gp140C form, two of the R residues in and near the furin cleavage site are changed to E, e.g., RRVVEREKR (SEQ ID NO: 2) is changed to ERVVEREKE (SEQ ID NO: 3), and is one example of an uncleaved gp140 form. Another example is the gp140C form which has the REKR site (SEQ ID NO: 1) changed to SEKS (SEQ ID NO: 4). See supra for references.

Envelope gp140CF refers to a gp140 HIV-1 envelope design with a deletion of the cleavage (C) site and fusion (F) region. Envelope gp140CFI refers to a gp140 HIV-1 envelope design with a deletion of the cleavage (C) site, fusion (F) and immunodominant (I) region in gp41. See Chakrabarti et al. Journal of Virology vol. 76, pp. 5357-5368 (2002) see for example FIG. 1, and Second paragraph in the Introduction on p. 5357; Binley et al. Journal of Virology vol. 76, pp. 2606-2616 (2002) for example at Abstract; Gao et al. Journal of Virology vol. 79, pp. 1154-1163 (2005); Liao et al. Virology vol. 353(2): 268-282 (2006).

In certain embodiments, the envelope design in accordance with the present invention involves deletion of residues (e.g., 5-11, 5, 6, 7, 8, 9, 10, or 11 amino acids) at the N-terminus. For delta N-terminal design, amino acid residues ranging from 4 residues or even fewer to 14 residues or even more are deleted. These residues are between the maturation (signal peptide, usually ending with CX, X can be any amino acid) and "VPVXXXX . . . ". In case of CH505 T/F Env as an example, 8 amino acids (italicized and underlined in the below sequence) were deleted:

```
                                    (SEQ ID NO: 5)
MRVMGIQRNYPQWWIWSMLGFWMLMICNGMWVTVYYGVPVWKEAKTTLFC

ASDAKAYEKEVHNVWATHACVPTDPNPQE . . .

(rest of envelope sequence is indicated as

". . .").
```

In other embodiments, the delta N-design described for CH505 T/F envelope can be used to make delta N-designs of other CH505 envelopes. In certain embodiments, the invention relates generally to an immunogen, gp160, gp120 or gp140, without an N-terminal Herpes Simplex gD tag substituted for amino acids of the N-terminus of gp120, with an HIV leader sequence (or other leader sequence), and without the original about 4 to about 25, for example 4, 5, 6, 7, 8, 9, 10, 11, 12, 13, 14, 15, 16, 17, 18, 19, 20, 21, 22, 23, 24, 25 amino acids of the N-terminus of the envelope (e.g. gp120). See WO2013/006688, e.g. at pages 10-12, the contents of which publication is hereby incorporated by reference in its entirety.

The general strategy of deletion of N-terminal amino acids of envelopes results in proteins, for example gp120s, expressed in mammalian cells that are primarily monomeric, as opposed to dimeric, and, therefore, solves the production and scalability problem of commercial gp120 Env vaccine production. In other embodiments, the amino acid deletions at the N-terminus result in increased immunogenicity of the envelopes.

In certain embodiments, the invention provides envelope sequences, amino acid sequences and the corresponding nucleic acids, and in which the V3 loop is substituted with the following V3 loop sequence TRPNNNTRKSIRIGPGQTFY ATGDIIGNIRQAH (SEQ ID NO: 6). This substitution of the V3 loop reduced product cleavage and improves protein yield during recombinant protein production in CHO cells.

In certain embodiments, the CH505 envelopes will have added certain amino acids to enhance binding of various broad neutralizing antibodies. Such modifications could include but not limited to, mutations at W680G or modification of glycan sites for enhanced neutralization.

In certain aspects, the invention provides composition and methods which use a selection of sequential CH505 Envs, as gp120s, gp 140s cleaved and uncleaved, gp145s, gp150s and gp160s, stabilized and/or multimerized trimers, as proteins, DNAs, RNAs, or any combination thereof, administered as primes and boosts to elicit immune response. Sequential CH505 Envs as proteins would be co-administered with nucleic acid vectors containing Envs to amplify antibody induction. In certain embodiments, the compositions and methods include any immunogenic HIV-1 sequences to give the best coverage for T cell help and cytotoxic T cell induction. In certain embodiments, the compositions and methods include mosaic and/or consensus HIV-1 genes to give the best coverage for T cell help and cytotoxic T cell induction. In certain embodiments, the compositions and methods include mosaic group M and/or consensus genes to give the best coverage for T cell help and cytotoxic T cell induction. In some embodiments, the mosaic genes are any suitable gene from the HIV-1 genome. In some embodiments, the mosaic genes are Env genes, Gag genes, Pol genes, Nef genes, or any combination thereof. See e.g. U.S. Pat. No. 7,951,377. In some embodiments the mosaic genes are bivalent mosaics. In some embodiments the mosaic genes are trivalent. In some embodiments, the mosaic genes are administered in a suitable vector with each immunization with Env gene inserts in a suitable vector and/or as a protein. In some embodiments, the mosaic genes, for example as bivalent mosaic Gag group M consensus genes, are administered in a suitable vector, for example but not limited to HSV2, would be administered with each immunization with Env gene inserts in a suitable vector, for example but not limited to HSV-2.

In certain aspects the invention provides compositions and methods of Env genetic immunization either alone or with Env proteins to recreate the swarms of evolved viruses that have led to bnAb induction. Nucleotide-based vaccines offer a flexible vector format to immunize against virtually any protein antigen. Currently, two types of genetic vaccination are available for testing-DNAs and mRNAs.

In certain aspects the invention contemplates using immunogenic compositions wherein immunogens are delivered as DNA. See Graham B S, Enama M E, Nason M C, Gordon I J, Peel S A, et al. (2013) DNA Vaccine Delivered by a Needle-Free Injection Device Improves Potency of Priming for Antibody and CD8+ T-Cell Responses after rAd5 Boost in a Randomized Clinical Trial. PLoS ONE 8(4): e59340, page 9. Various technologies for delivery of nucleic acids, as DNA and/or RNA, so as to elicit immune response, both T-cell and humoral responses, are known in the art and are under developments. In certain embodiments, DNA can be delivered as naked DNA. In certain embodiments, DNA is formulated for delivery by a gene gun. In certain embodiments, DNA is administered by electroporation, or by a needle-free injection technologies, for example but not limited to Biojector® device. In certain embodiments, the DNA is inserted in vectors. The DNA is delivered using a suitable vector for expression in mammalian cells. In certain embodiments the nucleic acids encoding the envelopes are optimized for expression. In certain embodiments DNA is optimized, e.g. codon optimized, for expression. In certain embodiments the nucleic acids are optimized for expression in vectors and/or in mammalian cells. In non-limiting embodiments these are bacterially derived vectors, adenovirus based vectors, rAdenovirus (e.g. Barouch D H, et al. Nature Med. 16: 319-23, 2010), recombinant mycobacteria (e.g. rBCG or *M smegmatis*) (Yu, J S et al. Clinical Vaccine Immunol. 14: 886-093, 2007; ibid 13: 1204-11, 2006), and recombinant vaccinia type of vectors (Santra S. Nature Med. 16: 324-8, 2010), for example but not limited to ALVAC, replicating (Kibler K V et al., PLoS One 6: e25674, 2011 Nov. 9.) and non-replicating (Perreau M et al. J. virology 85: 9854-62, 2011) NYVAC, modified vaccinia Ankara (MVA)), adeno-associated virus, Venezuelan equine encephalitis (VEE) replicons, Herpes Simplex Virus vectors, and other suitable vectors.

In certain aspects the invention contemplates using immunogenic compositions wherein immunogens are delivered as DNA or RNA in suitable formulations. Various technologies which contemplate using DNA or RNA, or may use complexes of nucleic acid molecules and other entities to be used in immunization. In certain embodiments, DNA or RNA is administered as nanoparticles consisting of low dose antigen-encoding DNA formulated with a block copolymer (amphiphilic block copolymer 704). See Cany et al., Journal of Hepatology 2011 vol. 54 j 115-121; Arnaoty et al., Chapter 17 in Yves Bigot (ed.), Mobile Genetic Elements: Protocols and Genomic Applications, Methods in Molecular Biology, vol. 859, pp 293-305 (2012); Arnaoty et al. (2013) Mol Genet Genomics. 2013 August; 288(7-8):347-63. Nanocarrier technologies called Nanotaxi® for immunogenic macromolecules (DNA, RNA, Protein) delivery are under development. See for example technologies developed by incellart.

In certain aspects the invention contemplates using immunogenic compositions wherein immunogens are delivered as recombinant proteins. Various methods for production and purification of recombinant proteins, including trimers such as but not limited to SOSIP based trimers, suitable for use in immunization are known in the art. In certain embodiments recombinant proteins are produced in CHO cells.

The immunogenic envelopes can also be administered as a protein boost in combination with a variety of nucleic acid envelope primes (e.g., HIV-1 Envs delivered as DNA expressed in viral or bacterial vectors).

Dosing of proteins and nucleic acids can be readily determined by a skilled artisan. A single dose of nucleic acid can range from a few nanograms (ng) to a few micrograms (g) or milligram of a single immunogenic nucleic acid. Recombinant protein dose can range from a few g micrograms to a few hundred micrograms, or milligrams of a single immunogenic polypeptide.

Administration: The compositions can be formulated with appropriate carriers using known techniques to yield compositions suitable for various routes of administration. In certain embodiments the compositions are delivered via intramascular (IM), via subcutaneous, via intravenous, via nasal, via mucosal routes, or any other suitable route of immunization.

The compositions can be formulated with appropriate carriers and adjuvants using techniques to yield compositions suitable for immunization. The compositions can include an adjuvant, such as, for example but not limited to, alum, poly IC, MF-59 or other squalene-based adjuvant, ASOIB, or other liposomal based adjuvant suitable for protein or nucleic acid immunization. In certain embodiments, the adjuvant is GSK AS01E adjuvant containing MPL and QS21. This adjuvant has been shown by GSK to be as potent as the similar adjuvant AS01B but to be less reactogenic using HBsAg as vaccine antigen [Leroux-Roels et al., JABS Conference, April 2013]. In certain embodiments, TLR agonists are used as adjuvants. In other embodiment, adjuvants which break immune tolerance are included in the immunogenic compositions.

In certain embodiments, the compositions and methods comprise any suitable agent or immune modulation which could modulate mechanisms of host immune tolerance and release of the induced antibodies. In non-limiting embodiments modulation includes PD-1 blockade; T regulatory cell depletion; CD40L hyperstimulation; soluble antigen administration, wherein the soluble antigen is designed such that the soluble agent eliminates B cells targeting dominant epitopes, or a combination thereof. In certain embodiments, an immunomodulatory agent is administered in at time and in an amount sufficient for transient modulation of the subject's immune response so as to induce an immune response which comprises broad neutralizing antibodies against HIV-1 envelope. Non-limiting examples of such agents is any one of the agents described herein: e.g. chloroquine (CQ), PTP1B Inhibitor—CAS 765317-72-4—Calbiochem or MSI 1436 clodronate or any other bisphosphonate; a Foxo1 inhibitor, e.g. 344355 Foxo1 Inhibitor, AS1842856—Calbiochem; Gleevac, anti-CD25 antibody, anti-CCR4 Ab, an agent which binds to a B cell receptor for a dominant HIV-1 envelope epitope, or any combination thereof. In non-limiting embodiments, the modulation includes administering an anti-CTLA4 antibody. Non-limiting examples are ipilimumab and tremelimumab. In certain embodiments, the methods comprise administering a second immunomodulatory agent, wherein the second and first immunomodulatory agents are different.

There are various host mechanisms that control bNAbs. For example highly somatically mutated antibodies become autoreactive and/or less fit (Immunity 8: 751, 1998; PloS Comp. Biol. 6 e1000800, 2010; J. Thoret. Biol. 164:37, 1993); Polyreactive/autoreactive naïve B cell receptors (unmutated common ancestors of clonal lineages) can lead to deletion of Ab precursors (Nature 373: 252, 1995; PNAS 107: 181, 2010; J. Immunol. 187: 3785, 2011); Abs with long HCDR3 can be limited by tolerance deletion (JI 162: 6060, 1999; JCI 108: 879, 2001). BnAb knock-in mouse models are providing insights into the various mechanisms of tolerance control of MPER BnAb induction (deletion, anergy, receptor editing). Other variations of tolerance control likely will be operative in limiting BnAbs with long HCDR3s, high levels of somatic hypermutations.

Various antibodies names are used throughout the application. Below is listing of antibodies names correlation: CH490=CH235.6; CH491=CH235.7; CH492=CH235.8; CH493=CH235.9; CH555=CH235.10; CH556=CH235.11; CH557=CH235.12

TABLE 1

Summary of CH505 proteins and sequences. (1) See WO2014042669 (FIG. 17).

| | gp160 | gp120 delta8 | gp145 | chim.6R.SOSIP.664 (SOSIP.I) | chim.6R.DS.SOSIP.664 (SIOSIP.I) | CHIM.6R.SOSIP.664V4.1 (SOSIP.III) | CHIM.-6R.SOSIP.664V4.2 |
|---|---|---|---|---|---|---|---|
| CH505 TF aa | (1) | (1) | | FIG. 23A | FIG. 23A | FIG. 23A | FIG. 23A |
| One embodiment of a nucleic acid | (1) | (1) | | | | | |
| W53.16 | (1) | (1) | | FIG. 23A | FIG. 23A | FIG. 23A | FIG. 23A |
| One embodiment of a nucleic acid | (1) | (1) | | | | | |
| W78.33 | (1) | (1) | | | | FIG. 23A | FIG. 23A |
| One embodiment of a nucleic acid | (1) | (1) | | | | | |
| W100.B6 | (1) | (1) | | | | FIG. 23A | FIG. 23A |
| One embodiment of a nucleic acid | (1) | (1) | | | | | |
| M5 aa | FIG. 17B | FIG. 17A | FIG. 19A | | | FIG. 23A | FIG. 23A |
| One embodiment of a nucleic acid | | | | | | | |
| M11 aa | FIG. 17B | FIG. 19A | FIG. 19A | | | FIG. 23A | FIG. 23A |
| One embodiment of a nucleic acid | | | | | | | |
| W20.14 aa | FIG. 17B | FIG. 19A | FIG. 19A | | | FIG. 23A | FIG. 23A |
| One embodiment of a nucleic acid | | | | | | | |
| W30.20 aa | FIG. 17B | FIG. 19A | FIG. 19A | | | FIG. 23A | FIG. 23A |
| One embodiment of a nucleic acid | | | | | | | |
| W30.12 aa | FIG. 17B | FIG. 19A | FIG. 19A | | | FIG. 23A | FIG. 23A |
| One embodiment of a nucleic acid | | | | | | | |
| W136.B18 aa | FIG. 19B | FIG. 19A | FIG. 19A | | | FIG. 23A | FIG. 23A |
| One embodiment of a nucleic acid | | | | | | | |
| W30.25 aa | FIG. 17A | | | | | FIG. 23A | FIG. 23A |
| One embodiment of a nucleic acid | FIG. 17B | | | | | | |
| W053.25 aa | FIG. 17A | | | | | FIG. 23A | FIG. 23A |
| One embodiment of a nucleic acid | FIG. 17B | | | | | | |
| W053.29 aa | FIG. 17A | | | | | FIG. 23A | FIG. 23A |
| One embodiment of a nucleic acid | FIG. 17B | | | | | | |

It is readily understood that the envelope glycoproteins referenced in various examples and figures comprise a signal/leader sequence. It is well known in the art that HIV-1 envelope glycoprotein is a secretory protein with a signal or leader peptide sequence that is removed during processing and recombinant expression (without removal of the signal peptide, the protein is not secreted). See for example Li et al. Control of expression, glycosylation, and secretion of HIV-1 gp120 by homologous and heterologous signal sequences. Virology 204(1):266-78 (1994) ("Li et al. 1994"), at first paragraph, and Li et al. Effects of inefficient cleavage of the signal sequence of HIV-1 gp120 on its association with calnexin, folding, and intracellular transport. PNAS 93:9606-9611 (1996) ("Li et al. 1996"), at 9609. Any suitable signal sequence could be used. In some embodiments the leader sequence is the endogenous leader sequence. Most of the gp120 and gp160 amino acid sequences include the endogenous leader sequence. In other non-limiting examples the leaders sequence is human Tissue Plasminogen Activator (TPA) sequence, human CD5 leader sequence (e.g. MPMGSLQPLATLYLLGMLVASVLA (SEQ ID NO: 7)). Most of the chimeric designs include CD5 leader sequence. A skilled artisan appreciates that when used as immunogens, and for example when recombinantly produced, the amino acid sequences of these proteins do not comprise the leader peptide sequences.

Nomenclature for trimers: chim.6R.DS.SOSIP.664 is SOSIP.I CHIM.6R.SOSIP.664 is SOSIP.II; CHIM.6R.SOSIP.664V4.1 is SOSIP.III.

The invention is described in the following non-limiting examples.

EXAMPLES

Example 1

HIV-1 sequences, including envelopes, and antibodies from HIV-1 infected individual CH505 were isolated as described in Liao et al. (2013) Nature 496, 469-476 including supplementary materials; See also Gao et al. (2014) *Cell* 158:481-491.

Recombinant HIV-1 Proteins

HIV-1 Env genes for subtype B, 63521, subtype C, 1086, and subtype CRF_01, 427299, as well as subtype C, CH505 autologous transmitted/founder Env were obtained from acutely infected HIV-1 subjects by single genome amplification, codon-optimized by using the codon usage of highly expressed human housekeeping genes, de novo synthesized (GeneScript) as gp140 or gp120 (AE.427299) and cloned into a mammalian expression plasmid pcDNA3.1/hygromycin (Invitrogen). Recombinant Env glycoproteins were produced in 293F cells cultured in serum-free medium and transfected with the HIV-1 gp140- or gp120-expressing pcDNA3.1 plasmids, purified from the supernatants of transfected 293F cells by using *Galanthus nivalis* lectin-agarose (Vector Labs) column chromatography, and stored at −80° C. Select Env proteins made as CH505 transmitted/founder Env were further purified by superose 6 column chromatography to trimeric forms, and used in binding assays that showed similar results as with the lectin-purified oligomers.

ELISA

Binding of patient plasma antibodies and CH103, and DH235(CH235), See Gao et al. (2014) *Cell* 158:481-491, clonal lineage antibodies to autologous and heterologous HIV-1 Env proteins was measured by ELISA as described previously. Plasma samples in serial threefold dilutions starting at 1:30 to 1:521,4470 or purified monoclonal antibodies in serial threefold dilutions starting at 100 μg ml−1 to 0.000 μg ml−1 diluted in PBS were assayed for binding to autologous and heterologous HIV-1 Env proteins. Binding of biotin-labelled CH103 at the subsaturating concentration was assayed for cross-competition by unlabeled HIV-1 antibodies and soluble CD4-Ig in serial fourfold dilutions starting at 10 μg ml−1. The half-maximal effective concentration (EC50) of plasma samples and monoclonal antibodies to HIV-1 Env proteins were determined and expressed as either the reciprocal dilution of the plasma samples or concentration of monoclonal antibodies.

Surface Plasmon Resonance Affinity and Kinetics Measurements

Binding Kd and rate constant (association rate (Ka)) measurements of monoclonal antibodies and all candidate UCAs to the autologous Env C. CH05 gp140 and/or the heterologous Env B.63521 gp120 are carried out on BIAcore 3000 instruments as described previously. Anti-human IgG Fc antibody (Sigma Chemicals) is immobilized on a CM5 sensor chip to about 15,000 response units and each antibody is captured to about 50-200 response units on three individual flow cells for replicate analysis, in addition to having one flow cell captured with the control Synagis (anti-RSV) monoclonal antibody on the same sensor chip. Double referencing for each monoclonal antibody-HIV-1 Env binding interactions is used to subtract nonspecific binding and signal drift of the Env proteins to the control surface and blank buffer flow, respectively. Antibody capture level on the sensor surface is optimized for each monoclonal antibody to minimize rebinding and any associated avidity effects. C.CH505 Env gp140 protein is injected at concentrations ranging from 2 to 25 μg ml−1, and B.63521 gp120 was injected at 50-400 μg ml−1 for UCAs and early intermediates IA8 and IA4, 10-100 μg ml−1 for intermediate IA3, and 1-25 μg ml−1 for the distal and mature monoclonal antibodies. All curve-fitting analyses are performed using global fit of to the 1:1 Langmuir model and are representative of at least three measurements. All data analysis was performed using the BIAevaluation 4.1 analysis software (GE Healthcare).

Neutralization Assays

Neutralizing antibody assays in TZM-bl cells are performed as described previously. Neutralizing activity of plasma samples in eight serial threefold dilutions starting at 1:20 dilution and for recombinant monoclonal antibodies in eight serial threefold dilutions starting at 50 μg ml−1 are tested against autologous and herologous HIV-1 Env-pseudotyped viruses in TZM-bl-based neutralization assays using the methods known in the art. Neutralization breadth of CH103 is determined using a panel of 196 of geographically and genetically diverse Env-pseudoviruses representing the major circulated genetic subtypes and circulating recombinant forms. HIV-1 subtype robustness is derived from the analysis of HIV-1 clades over time. The data are calculated as a reduction in luminescence units compared with control wells, and reported as IC50 in either reciprocal dilution for plasma samples or in micrograms per microlitre for monoclonal antibodies.

The GenBank accession numbers for 292 CH505 Env proteins are KC247375-KC247667, and accessions for 459 $V_HDJ_H$ and 174 $V_LJ_L$ sequences of antibody members in the CH103 clonal lineage are KC575845-KC576303 and KC576304-KC576477, respectively.

Example 2

Binding of sequential envelopes to CH103 and CH235 CD4 binding site bnAb lineages members.

The binding assay was an ELISA with the envelope protein bound to the well surface of a 96 well plate, and the antibody in questions incubated with the envelope bound to the plate. After washing, an enzyme-labeled anti-human IgG antibody was added and after incubation, washed away. The intensity of binding was determined by the intensity of enzyme-activated color in the well.

TABLE 2

ELISA binding, log-transformed area under the curve (AUC) values for a realization with four Env-derived gp120 antigens, assayed against members of the CH103 bnAb lineage from universal ancestor (UCA), through intermediate ancestors (IA8-IA1) to the mature bnAb. Values of 0 indicate no binding. The transmitted-founder (TF) antigen was derived from Env w004.3.

| Antigen | UCA | IA8 | IA7 | IA6 | IA4 | IA3 | CH105 | IA2 | CH104 | IA1 | CH106 | CH103 |
|---|---|---|---|---|---|---|---|---|---|---|---|---|
| TF | 3.5 | 5.5 | 9.2 | 9.1 | 10.1 | 11 | 11.2 | 10.8 | 10.4 | 10.4 | 11.3 | 12.6 |
| w053.16 | 0 | 0 | 0 | 0 | 0.2 | 1.1 | 9 | 9.3 | 9.9 | 8.8 | 9.8 | 11.6 |
| w078.33 | 0 | 0 | 0 | 0 | 0 | 0 | 8.9 | 9 | 9 | 8.2 | 9.5 | 11.1 |
| w100.B6 | 0 | 0 | 0 | 0 | 0 | 0 | 11 | 12.1 | 11 | 12.2 | 11.8 | 7.1 |

TABLE 3

ELISA binding, log-transformed area under the curve (AUC) values for a realization with five Env-derived gp120 antigens, assayed against members of the CH103 bnAb lineage from universal ancestor (UCA), through intermediate ancestors (IA8-IA1) to the mature bnAb. Values of 0 indicate no binding. Antigen names beginning with M were synthesized by site-directed mutagenesis.

| Antigen | UCA | IA8 | IA7 | IA6 | IA4 | IA3 | CH105 | IA2 | CH104 | IA1 | CH106 | CH103 |
|---|---|---|---|---|---|---|---|---|---|---|---|---|
| M11 | 2.6 | 6.2 | 10.1 | 10 | 10.5 | 11.8 | 11.7 | 12.7 | 12 | 12.2 | 12.8 | 13.4 |
| M5 | 0 | 0.6 | 2.3 | 3.3 | 3.8 | 6.8 | 8.6 | 7.8 | 9 | 7 | 8.4 | 9.8 |
| w020.14 | 0.3 | 3.4 | 7.2 | 7.9 | 8.6 | 9.5 | 10.4 | 11 | 10.4 | 10.3 | 11.2 | 12.6 |
| w030.28 | 0 | 1.6 | 3.5 | 6.3 | 6.5 | 7.7 | 9.1 | 11.1 | 10.7 | 10.1 | 11.7 | 12.8 |
| w078.15 | 0 | 0 | 0.7 | 1 | 1.3 | 3 | 10.1 | 11.5 | 10.8 | 10.9 | 11 | 10.7 |
| w053.31 | 0 | 0 | 0 | 0 | 0 | 0 | 13.5 | 13.3 | 13.7 | 13.4 | 13.4 | 13.6 |

TABLE 4

ELISA binding, log-transformed area under the curve (AUC) values for a realization with five Env-derived gp120 antigens, assayed against members of the DH235 (CH235) bnAb helper lineage from universal ancestor (UCA), through intermediate ancestors (I4-I1) to mature bnAbs. Values of 0 indicate no binding. Antigen names beginning with M were synthesized by site-directed mutagenesis.

| Antigen | UCA | I4 | I3 | I2 | I1 | DH235 | CH236 | CH239 | CH240 | CH241 |
|---|---|---|---|---|---|---|---|---|---|---|
| M11 | 0 | 0 | 0 | 0 | 2.8 | 7.6 | 1.4 | 1.4 | 0.5 | 9.7 |
| M5 | 0.2 | 1.4 | 7 | 6.9 | 9.2 | 11.4 | 7.3 | 12.9 | 7.4 | 14.5 |
| w020.14 | 0 | 0 | 2.7 | 1.2 | 6.5 | 9.9 | 6.7 | 9 | 3.8 | 13.1 |
| w030.28 | 0 | 0 | 0 | 0 | 2.4 | 6.7 | 1.5 | 3.6 | 0.3 | 9.6 |
| w078.15 | 0 | 0 | 0 | 0 | 0 | 0 | 0 | 0 | 0 | 0 |
| w053.31 | 0 | 0 | 0 | 0 | 0 | 1.1 | 0 | 0 | 0 | 1.4 |

TABLE 5

ELISA binding, log-transformed area under the curve (AUC) values for a realization that embodies ten Env-derived gp120 antigens, assayed against members of the CH103 bnAb lineage from universal ancestor (UCA), through intermediate ancestors (IA8-IA1) to the mature bnAb. Values of 0 indicate no binding. Antigen names beginning with M were synthesized by site-directed mutagenesis.

| Antigen | UCA | IA8 | IA7 | IA6 | IA4 | IA3 | CH105 | IA2 | CH104 | IA1 | CH106 | CH103 |
|---|---|---|---|---|---|---|---|---|---|---|---|---|
| M11 | 2.6 | 6.2 | 10.1 | 10 | 10.5 | 11.8 | 11.7 | 12.7 | 12 | 12.2 | 12.8 | 13.4 |
| M5 | 0 | 0.6 | 2.3 | 3.3 | 3.8 | 6.8 | 8.6 | 7.8 | 9 | 7 | 8.4 | 9.8 |
| w020.14 | 0.3 | 3.4 | 7.2 | 7.9 | 8.6 | 9.5 | 10.4 | 11 | 10.4 | 10.3 | 11.2 | 12.6 |
| w030.28 | 0 | 1.6 | 3.5 | 6.3 | 6.5 | 7.7 | 9.1 | 11.1 | 10.7 | 10.1 | 11.7 | 12.8 |
| w078.15 | 0 | 0 | 0.7 | 1 | 1.3 | 3 | 10.1 | 11.5 | 10.8 | 10.9 | 11 | 10.7 |
| w053.16 | 0 | 0 | 0 | 0 | 0.2 | 1.1 | 9 | 9.3 | 9.9 | 8.8 | 9.8 | 11.6 |
| w030.21 | 0 | 0 | 0 | 0 | 0 | 0 | 10.6 | 11.5 | 11.3 | 11.8 | 10.9 | 12.2 |
| w078.33 | 0 | 0 | 0 | 0 | 0 | 0 | 8.9 | 9 | 9 | 8.2 | 9.5 | 11.1 |

TABLE 5-continued

ELISA binding, log-transformed area under the curve (AUC) values for a realization that embodies ten Env-derived gp120 antigens, assayed against members of the CH103 bnAb lineage from universal ancestor (UCA), through intermediate ancestors (IA8-IA1) to the mature bnAb. Values of 0 indicate no binding. Antigen names beginning with M were synthesized by site-directed mutagenesis.

| Antigen | UCA | IA8 | IA7 | IA6 | IA4 | IA3 | CH105 | IA2 | CH104 | IA1 | CH106 | CH103 |
|---|---|---|---|---|---|---|---|---|---|---|---|---|
| w100.B6 | 0 | 0 | 0 | 0 | 0 | 0 | 11 | 12.1 | 11 | 12.2 | 11.8 | 7.1 |
| w053.31 | 0 | 0 | 0 | 0 | 0 | 0 | 13.5 | 13.3 | 13.7 | 13.4 | 13.4 | 13.6 |

Example 3

Combinations of antigens derived from CH505 envelope sequences for swarm immunizations Provided herein are non-limiting examples of combinations of antigens derived from CH505 envelope sequences for a swarm immunization. Without limitations, these selected combinations comprise envelopes which provide representation of the sequence and antigenic diversity of the HIV-1 envelope variants which lead to the induction and maturation of the CH103 and CH235 antibody lineages. The identification of bnAb lineage (CH103) and envelopes which bind preferentially to various members of this lineage provides a direct strategy for the selection of Envs (out of millions possible envelopes naturally occurring in an HIV-1 infected individual) that might have engaged UCA and participated in bnAb development, and thus could serve as immunogens in a vaccine formulation. The identification of helper lineage (CH235) and envelopes which bind preferentially to various members this lineage provides a direct strategy for the selection of Envs (out of millions possible envelopes naturally occurring in an HIV-1 infected individual) that might have engaged UCA and participated in bnAb development, and thus could serve as immunogens in a vaccine formulation.

The selection includes priming with a virus which binds to the UCA, for example a T/F virus or another early (e.g. but not limited to week 004.3, or 004.26) virus envelope. In certain embodiments the prime could include D-loop variants. In certain embodiments the boost could include D-loop variants. In certain embodiments, these D-loop variants are envelope escape mutants not recognized by the UCA. Non-limiting examples of such D-loop variants are envelopes designated as M10, M11, M19, M20, M21, M5, M6, M7, M8, M9, M14 (TF_M14), M24 (TF_24), M15, M16, M17, M18, M22, M23, M24, M25, M26. See Gao et al. (2014) *Cell* 158:481-491.

Non-limiting embodiments of envelopes selected for swarm vaccination are shown as the selections described below. A skilled artisan would appreciate that a vaccination protocol can include a sequential immunization starting with the "prime" envelope(s) and followed by sequential boosts, which include individual envelopes or combination of envelopes. In another vaccination protocol, the sequential immunization starts with the "prime" envelope(s) and is followed with boosts of cumulative prime and/or boost envelopes. In certain embodiments, the sequential immunization starts with the "prime" envelope(s) and is followed by boost(s) with all or various combinations of the envelopes in the selection. In certain embodiments, the prime does not include T/F sequence (W000.TF). In certain embodiments, the prime includes w004.03 envelope. In certain embodiments, the prime includes w004.26 envelope. In certain embodiment the prime includes M11. In certain embodiments the prime includes M5. In certain embodiments, the immunization methods do not include immunization with HIV-1 envelope T/F. In certain embodiments, the immunization methods do not include a schedule of four valent immunization with HIV-1 envelopes T/F, w053.16, w078.33, and w100.B6.

In certain embodiments, there is some variance in the immunization regimen; in some embodiments, the selection of HIV-1 envelopes may be grouped in various combinations of primes and boosts, either as nucleic acids, proteins, or combinations thereof.

In certain embodiments the immunization includes a prime administered as DNA, and MVA boosts. See Goepfert, et al. 2014; "Specificity and 6-Month Durability of Immune Responses Induced by DNA and Recombinant Modified Vaccinia Ankara Vaccines Expressing HIV-1 Virus-Like Particles" J Infect Dis. 2014 Feb. 9. [Epub ahead of print].

HIV-1 Envelope selection A (five envelopes): M11; w020.14; w030.28; w078.15; w053.31

HIV-1 Envelope selection B (six envelopes): M11; M5; w020.14; w030.28; w078.15; w053.31

HIV-1 Envelope selection C (ten envelopes): M11; M5; w020.14; w030.28; w078.15; w053.16; w030.21; w078.33; w100.B6; w053.31.

HIV-1 Envelopes selection D (six envelopes): M5, M11, 20.14, 30.28, 30.23, 136.B18.

HIV-1 Envelopes selection E (six envelopes): M5, M11, 20.14, 30.20, 30.23, 136.B18.

HIV-1 Envelopes selection F (six envelopes—P186 study): M5, M11, 20.14, 30.20, 30.12, 136.B18.

HIV-1 envelope selection G (EnvSeq-2): M5, 30.25; 53.25; 53.29.

HIV-1 envelope selection H (EnvSeq-3): M5, 30.20; 20.14, 30.12.

Selections using M5 as a prime, e.g. but not limited to D, E, F, G or H are expected to engage receptors and drive progression of CH235 lineage of antibodies.

The selections of CH505-Envs were down-selected from a series of 400 CH505 Envs isolated by single-genome amplification followed for 3 years after acute infection, based on experimental data. The enhanced neutralization breadth that developed in the CD4-binding site (bs) CH103 antibody lineage that arose in subject CH505 developed in conjunction with epitope diversification in the CH505's viral quasispecies. It was observed that at 6 months post-infection there was more diversification in the CD4bs epitope region in this donor than sixteen other acutely infected donors. Population breadth did not arise in the CH103 antibody lineage until the epitope began to diversify. A hypothesis is that the CH103 linage drove viral escape, but then the antibody adapted to the relatively resistant viral variants. As this series of events was repeated, the emerging antibodies evolved to tolerate greater levels of diversity in relevant sites, and began to be able to recognize and neutralize diverse heterologous forms for the virus and manifest population breadth. In certain embodiments, six envs are selected from CH505 sequences to reflect diverse variants for making Env pseudoviruses, with the goal of recapitulating CH505 HIV-1 antigenic diversity over time, making sure selected site (i.e. those sites reflecting major antigenic shifts) diversity was represented.

Specifically, for CH505 the virus and envelope evolution were mapped, and the CH103 CD4 binding-site bnAb evolution. In addition, 135 CH505 varied envelope pseudotyped viruses were made and tested them for neutralization sensitivity by members of the CH103 bnAb lineage (e.g, FIG. 3). From this large dataset, in one embodiment, six Env variants were chosen for immunization based on sequence diversity, and antigenic diversity, for example binding to antibodies in the CH103 and/or CH235 lineage (Tables 3-5).

In certain embodiments, the envelopes are selected based on Env mutants with sites under diversifying selection, in which the transmitted/founder (T/F) Env form vanished below 20% in any sample, i.e. escape variants; signature sites based on autologous neutralization data, i.e. Envs with statistically supported signatures for escape from members of the CH103 bnAb lineage; and sites with mutations at the contact sites of the CH103 antibody and HIV Env. In this manner, a sequential swarm of Envs was selected for immunization to represent the progression of virus escape mutants that evolved during bnAb induction and increasing neutralization breadth in the CH505 donor.

In certain embodiments, additional sequences are selected to contain five additional specific amino acid signatures of resistance that were identified at the global population level. These sequences contain statistically defined resistance signatures, which are common at the population level and enriched among heterologous viruses that CH103 fails to neutralize. When they were introduced into the TF sequence, they were experimentally shown to confer partial resistance to antibodies in the CH103 lineage. Following the reasoning that serial viral escape and antibody adaptation to escape is what ultimate selects for neutralizing antibodies that exhibit breadth and potency against diverse variants, in certain embodiments, inclusion of these variants in a vaccine may extend the breadth of vaccine-elicited antibodies even beyond that of the CH103 lineage. Thus the overarching goal will be to trigger a CH103-like lineage first using the CH505TF modified M11, that is well recognized by early CH103 ancestral states, then vaccinating with antigenic variants, to allow the antibody lineage to adapt through somatic mutation to accommodate the natural variants that arose in CH505. In certain embodiments, vaccination regimens include a total of five sequences (Selection A) that capture the antigenic diversity of CH505. In another embodiment, additional antigenic diversity is added (Selection B and C), to enable the induction of antibodies by vaccination that may have even greater breadth than those antibodies isolated from CH505.

In some embodiments, the CH505 sequences that represent the accumulation of viral sequence and antigenic diversity in the CD4bs epitope of CH103 in subject CH505 are represented by selection A, selection B, or selection C.

M11 is a mutant generated to include two mutations in the loop D (N279D+V281G relative to the TF sequence) that enhanced binding to the CH103 lineage. These were early escape mutations for another CD4bs autologous neutralizing antibody lineage, but might have served to promote early expansion of the CH103 lineage.

In certain embodiments, the two CH103 resistance signature-mutation sequences added to the antigenic swarm are: M14 (TF with S364P), and M24 (TF with S375H+T202K+L520F+G459E). They confer partial resistance to the TF with respect to the CH103 lineage. In certain embodiments, these D-loop mutants are administered in the boost.

Example 4

Immunization protocols in subjects with swarms of HIV-1 envelopes.

Immunization protocols contemplated by the invention include envelopes sequences as described herein including but not limited to nucleic acids and/or amino acid sequences of gp160s, gp150s, gp145, cleaved and uncleaved gp140s, stabilized trimers, e.g. but not limited to SOSIP trimers, gp120s, gp41s, N-terminal deletion variants as described herein, cleavage resistant variants as described herein, or codon optimized sequences thereof. A skilled artisan can readily modify the gp160 and gp120 sequences described herein to obtain these envelope variants. The swarm immunization selections can be administered in any subject, for example monkeys, mice, guinea pigs, or human subjects.

In non-limiting embodiments, the immunization includes a nucleic acid which is administered as DNA, for example in a modified vaccinia vector (MVA). In non-limiting embodiments, the nucleic acids encode gp160 envelopes. In other embodiments, the nucleic acids encode gp120 envelopes. In other embodiments, the boost comprises a recombinant gp120 envelope. The vaccination protocols include envelopes formulated in a suitable carrier and/or adjuvant, for example but not limited to alum. In certain embodiments the immunizations include a prime, as a nucleic acid or a recombinant protein, followed by a boost, as a nucleic acid or a recombinant protein. A skilled artisan can readily determine the number of boosts and intervals between boosts.

In some embodiments, the immunization methods comprise immunization prime with a nucleic acid, for example but not limited to priming two times with DNA. In some embodiments the nucleic acid prime is administered one, two, three or four times. In some embodiments the two DNA prime is administered via electroporation (DNA-EP). In some embodiments, the primer and boost is administered as RNA. The primes are followed by boost with sequential envelopes. The boosting envelopes could be in any suitable form, e.g. but not limited to gp140s, as soluble or stabilized SOSIP trimers.

Table 6 shows a non-limiting example of an immunization protocol using a selection of HIV-1 envelopes

| Envelope | Prime | Boost(s) | Boost(s) | Boost(s) |
|---|---|---|---|---|
| M11 | M11 as a nucleic acid e.g. DNA/MVA vector and/or protein | | | |

-continued

| Envelope | Prime | Boost(s) | Boost(s) | Boost(s) |
|---|---|---|---|---|
| W020.14 | | W020.14 as a nucleic acid e.g. DNA/MVA and/or protein | | |
| W030.28 | | | W030.28 as nucleic acid e.g. DNA/MVA and/or protein | |
| W078.15 | | | w078.15 as nucleic acid e.g. DNA/MVA and/or protein | |
| W100.B6 | | | | W100.B6 as nucleic acid e.g. DNA/MVA and/or protein |

Table 7 shows a non-limiting example of an immunization protocol using a selection of HIV-1 envelopes

| Envelope | Prime | Boost(s) | Boost(s) | Boost(s) |
|---|---|---|---|---|
| M11 | M11 as a nucleic acid e.g. DNA/MVA vector and/or protein | M11 as a nucleic acid e.g. DNA/MVA vector and/or protein | M11 as a nucleic acid e.g. DNA/MVA vector and/or protein | M11 as a nucleic acid e.g. DNA/MVA vector and/or protein |
| W020.14 | | W020.14 as a nucleic acid e.g. DNA/MVA and/or protein | W020.14 as a nucleic acid e.g. DNA/MVA and/or protein | W020.14 as a nucleic acid e.g. DNA/MVA and/or protein |
| W030.28 | | | W030.28 as nucleic acid e.g. DNA/MVA and/or protein | W030.28 as nucleic acid e.g. DNA/MVA and/or protein |
| W078.15 | | | w078.15 as nucleic acid e.g. DNA/MVA and/or protein | w078.15 as nucleic acid e.g. DNA/MVA and/or protein |
| W100.B6 | | | | W100.B6 as nucleic acid e.g. DNA/MVA and/or protein |

In certain embodiments, after administering a prime with M11, subsequent immunizations include all other envelopes as nucleic acids and/or proteins.

Table 8 shows a non-limiting example of an immunization protocol using a swarm of HIV-1 envelopes

| Envelope | Prime | Prime/Boost | Boost(s) | Boost(s) | Boost(s) |
|---|---|---|---|---|---|
| M11 | M11 as a nucleic acid e.g. DNA/MVA vector and/or protein | | | | |
| M5 | | M5 as a nucleic acid e.g. DNA/MVA and/or protein | | | |
| W020.14 | | | W020.14 as a nucleic acid e.g. DNA/MVA and/or protein | | |
| W030.28 | | | | W030.28 as nucleic acid e.g. DNA/MVA and/or protein | |

-continued

| Envelope | Prime | Prime/Boost | Boost(s) | Boost(s) | Boost(s) |
| --- | --- | --- | --- | --- | --- |
| W078.15 | | | | w078.15 as nucleic acid e.g. DNA/MVA and/or protein | |
| W100.B6 | | | | | W100.B6 as nucleic acid e.g. DNA/MVA and/or protein |

Table 9 shows anon-limiting example of an immunization protocol using a swarm of HIV-1 envelopes

| Envelope | Prime | Prime/Boost | Boost(s) | Boost(s) | Boost(s) |
| --- | --- | --- | --- | --- | --- |
| M11 | M11 as a nucleic acid e.g. DNA/MVA vector and/or protein | M11 as a nucleic acid e.g. DNA/MVA vector and/or protein | M11 as a nucleic acid e.g. DNA/MVA vector and/or protein | M11 as a nucleic acid e.g. DNA/MVA vector and/or protein | M11 as a nucleic acid e.g. DNA/MVA vector and/or protein |
| M5 | Optionally M5 as a nucleic acid e.g. DNA/MVA and/or protein | M5 as a nucleic acid e.g. DNA/MVA and/or protein | M5 as a nucleic acid e.g. DNA/MVA and/or protein | M5 as a nucleic acid e.g. DNA/MVA and/or protein | M5 as a nucleic acid e.g. DNA/MVA and/or protein |
| W020.14 | | | W020.14 as a nucleic acid e.g. DNA/MVA and/or protein | W020.14 as a nucleic acid e.g. DNA/MVA and/or protein | W020.14 as a nucleic acid e.g. DNA/MVA and/or protein |
| W030.28 | | | | W030.28 as nucleic acid e.g. DNA/MVA and/or protein | W030.28 as nucleic acid e.g. DNA/MVA and/or protein |
| W078.15 | | | | w078.15 as nucleic acid e.g. DNA/MVA and/or protein | w078.15 as nucleic acid e.g. DNA/MVA and/or protein |
| W100.B6 | | | | | W100.B6 as nucleic acid e.g. DNA/MVA and/or protein |

In certain embodiments, after administering a prime with M11 and optionally with M5, subsequent immunizations include all other envelopes as nucleic acids and/or proteins.

Table 10 shows a non-limiting example of immunization protocol using a selection of ten HIV-1 envelopes

| Envelope | Prime | Prime/Boost | Boost(s) | Boost(s) | Boost(s) | Boost(s) | Boost(s) | Boost(s) | Boost(s) |
| --- | --- | --- | --- | --- | --- | --- | --- | --- | --- |
| M11 | M11 as a nucleic acid e.g. DNA/MVA vector and/or protein | | | | | | | | |
| M5 | | M5 as a nucleic acid e.g. DNA/MVA and/or protein | | | | | | | |
| W020.14 | | | W020.14 as a nucleic acid e.g. DNA/MVA and/or protein | | | | | | |

-continued

| Envelope | Prime | Prime/Boost | Boost(s) | Boost(s) | Boost(s) | Boost(s) | Boost(s) | Boost(s) | Boost(s) |
|---|---|---|---|---|---|---|---|---|---|
| W030.28 | | | | W030.28 as nucleic acid e.g. DNA/MVA and/or protein | | | | | |
| W078.15 | | | | w078.15 as nucleic acid e.g. DNA/MVA and/or protein | | | | | |
| W053.16 | | | | | W053.16 as nucleic acid e.g. DNA/MVA and/or protein | | | | |
| W030.21 | | | | | | W030.21 as nucleic acid e.g. DNA/MVA and/or protein | | | |
| W078.33 | | | | | | | W078.33 as nucleic acid e.g. DNA/MVA and/or protein | | |
| W100.B6 | | | | | | | | W100.B6 as nucleic acid e.g. DNA/MVA and/or protein | |
| W053.31 | | | | | | | | | W053.31 as nucleic acid e.g. DNA/MVA and/or protein |

Table 11 shows anon-limiting example of immunization protocol using a selection of six HIV-1 envelopes

| Envelope | Prime | Prime/Boost | Boost(s) | Boost(s) | Boost(s) |
|---|---|---|---|---|---|
| M11 | M11 as a nucleic acid e.g. DNA/MVA vector and/or protein | M11 as a nucleic acid e.g. DNA/MVA vector and/or protein | M11 as a nucleic acid e.g. DNA/MVA vector and/or protein | M11 as a nucleic acid e.g. DNA/MVA vector and/or protein | M11 as a nucleic acid e.g. DNA/MVA vector and/or protein |
| M5 | Optionally M5 as a nucleic acid e.g. DNA/MVA and/or protein | M5 as a nucleic acid e.g. DNA/MVA and/or protein | M5 as a nucleic acid e.g. DNA/MVA and/or protein | M5 as a nucleic acid e.g. DNA/MVA and/or protein | M5 as a nucleic acid e.g. DNA/MVA and/or protein |
| W020.14 | | | W020.14 as a nucleic acid e.g. DNA/MVA and/or protein | W020.14 as a nucleic acid e.g. DNA/MVA and/or protein | W020.14 as a nucleic acid e.g. DNA/MVA and/or protein |
| W030.20 | | | | W030.20 as nucleic acid e.g. DNA/MVA and/or protein | W030.20 as nucleic acid e.g. DNA/MVA and/or protein |

-continued

| Envelope | Prime | Prime/Boost | Boost(s) | Boost(s) | Boost(s) |
|---|---|---|---|---|---|
| W030.12 | | | | w030.12 as nucleic acid e.g. DNA/MVA and/or protein | w030.12 as nucleic acid e.g. DNA/MVA and/or protein |
| W136.B18 | | | | | W136.B18 as nucleic acid e.g. DNA/MVA and/or protein |

Table 12 shows anon-limiting example of immunization protocol using a selection of six HIV-1 envelopes

| Envelope | Prime | Boost(s) | Boost(s) | Boost(s) | Boost(s) |
|---|---|---|---|---|---|
| M11 | M11 as a nucleic acid e.g. DNA/MVA vector and/or protein | | | | |
| M5 | Optionally M5 as a nucleic acid e.g. DNA/MVA and/or protein | | | | |
| W020.14 | | W020.14 as a nucleic acid e.g. DNA/MVA and/or protein | | | |
| W030.20 | | | W030.20 as nucleic acid e.g. DNA/MVA and/or protein | | |
| W030.12 | | | | w030.12 as nucleic acid e.g. DNA/MVA and/or protein | |
| W136.B18 | | | | | W136.B18 as nucleic acid e.g. DNA/MVA and/or protein |

In certain embodiments, after administering a prime with M11 and optionally with M5, subsequent immunizations include sequential or cumulative addition of the other envelopes as nucleic acids and/or proteins.

Table 13 shows anon-limiting example of immunization protocol using a selection of four HIV-1 envelopes

| Envelope | Prime | Boost(s) | Boost(s) | Boost(s) |
|---|---|---|---|---|
| M5 | M5as a nucleic acid e.g. DNA/MVA vector and/or protein | | | |
| W30.25 | | W30.25 as a nucleic acid e.g. DNA/MVA vector and/or protein | | |
| W53.25 | | | W53.25 as a nucleic acid e.g. DNA/MVA vector and/or protein | |
| W53.29 | | | | W53.29 as a nucleic acid e.g. DNA/MVA vector and/or protein |

In certain embodiments an immunization protocol could prime with a bivalent or trivalent Gag mosaic (Gag1 and Gag 2, Gag 1, Gag 2 and Gag3) in a suitable vector.

Example 5

Env mixtures of the CH505 virus are expected to induce the beginning of CD4 binding site BnAb lineages CH103 and CH235

The combinations of envelopes described in Examples 2-4 will be tested in any suitable subject. Suitable animal models include without limitation mice, including humanized mice, guinea pigs, or non-human primates (NHPs). For example an animal is administered with the following antigens, as DNA and/or proteins, in any suitable for, in the following immunization schedule: Prime: loop D mutant M5 and M11. That will give the best CH103 UCA binder (M11) and the best CH235 UCA binder (M5). Immunization 2: week 020.14. Immunization 3: Week 030.28. Immunization 4: week 078.15. Immunization 5: week 100.B6. Immunization 5: swarm of all six envelopes. Adjuvant is a TLR-4 agonist (GLA-synthetic monophosphoryl lipid A) in stable emulsion from Infectious Disease Research Institute, Seattle Wash.

In another embodiment, the prime is M5 and M11. The boost includes 20.14, 30.20, 30.12, and 136.B18, sequentially or additively.

Example 5A

Immunization elicits heterologous and autologous Tier 2 neutralizing antibodies.

While improved breadth of vaccine-induced neutralizing antibody responses against tier 2 viruses are needed for a protective HIV-1 vaccine, elicitation of bnAbs by vaccination has proven challenging.

This example shows elicitation of heterologous and autologous tier 2 neutralizing antibodies with sequential Env vaccination in rhesus macaques. See also FIGS. 25-34. The method comprised administering T/F envelope as gp145 DNA via electroporation, followed by boosting with T/F, w053.16, w078.33 and w100.B6 envelopes administered as gp140C envelopes.

Co-evolution studies of the CH103 lineage of antibodies and viruses from the same infected person CH505 provides a roadmap for how bnAbs develop during natural infection (Liao et al. Nature 2014; Bonsignori et al. Cell 2016).

This animal study compared the immunogenicity of CH505 gp140C oligomers to CH505-CD40 conjugates. We hypothesize that a roadblock to bnAb induction by vaccination is the lack of B cell stimulation by antigen presenting cells (dendritic cells and monocytes), and that bNAbs, similar to those in the CH103 bnAb lineage, can be induced by vaccination with sequential Envs from CH505 (TF, w053.16, w078.33 and w100.B6). In this experiment the T/F envelope was administered as a DNA prime. In some animals the boosting envelopes (TF, w053.16, w078.33 and w100.B6) were administered as gp140C envelopes. In some animals these envelopes were targeted to antigen presenting cells by a CD40 antibody—human anti-CD40 IgG4 was linked to the CH505 gp140C.

It is possible that the reduced immunogenicity of the anti-CD40 IgG4-CH505 Env regimen is due to anti-drug antibodies in rhesus macaques.

This example shows that: DNA-EP prime and gp140C oligomer boosts induced autologous tier 2 neutralization in 1 of 4 macaques; heterologous tier 2 neutralization of 9/12 tier 2 isolates was also elicited in the same macaque; and that CD4 binding site directed plasma IgG was present in wild-type Env immunized macaques. RSC3-reactive B cells were sorted from macaques and the binding and neutralization screening is ongoing.

This example demonstrated that sequential Env immunogens, including the sequential immunogens used in this study could induce heterologous Tier 2 neutralizatoin. One alternative to increase the response rate of bnAb induction is the use of sequential near-native soluble CH505 trimers (e.g. but not limited to SOSIP based trimers as described herein). Immunization with CH505 stabilized trimers while modulating immune tolerance with immune checkpoint inhibitors is also underway.

In some embodiments, the immunization methods could comprise immunization prime with a nucleic acid, for example but not limited to priming two times with DNA, In some embodiments the nucleic acid prime is administered one, two, three or four times. In some embodiments the two DNA prime is administered via electroporation (DNA-EP). In some embodiments the nucleic acid encodes any suitable form of the envelope. In some embodiments, the primer and boost is administered as RNA. The primes are followed by boost with sequential envelopes. The boosting envelopes could be in any suitable form, e.g. but not limited to gp140s, as soluble or stabilized SOSIP trimers, e.g. but not limited to SOSIP.III.

Example 6

Over the past five years, the HIV vaccine development field has realized that immunization with a single HIV envelope protein will not be successful at inducing bnAbs[1,2]. Moreover, with evidence for a role of host immune tolerance control mechanisms in limiting the induction of bnAbs[1,3], the biology of bnAbs has begun to be elucidated. The role of the structure of the Env immunogen is undoubtedly important, as the Env must contain sufficiently native bnAb epitopes to bind in optimal affinities to the unmutated common ancestor (UCA, naïve B cell receptors) of bnAb lineages[2,4]. Thus, the concept of B cell lineage immunogen design has arisen, whereby lineages of bnAbs are elucidated, and Envs chosen for sequential immunizations based on optimized affinity of Env immunogens for BCRs at sequential steps of the affinity maturation pathway of bnAb lineages[2]

While Envs have been designed for reacting with UCAs of heterologous bnAb lineages[4,5], we have taken the approach of defining, in select HIV-infected individuals who make bnAbs, the natural sequence of Envs that induced the bnAb lineages in order to make immunogen down selection an evidence-based decision. While such immunogens are designed for the UCA and intermediate antibodies of one particular bnAb lineage, they hold promise for inducing bnAb lineages in multiple individuals because of the remarkable conserved usage of VH and VL genes of bnAbs and the restricted nature of antibody motifs for many bnAb types, particularly for the gp41 membrane proximal region[6], the CD4 binding site[7] and the V1V2-glycan site[1,8-10].

Two Types of CD4 Binding Site Antibodies

There are several types of CD4 binding site (bs) bnAbs two of which are a) heavy chain complementarity determining region 3 (HCDR3) binders and b) CD4 mimicking bnAbs[7]. HCDR3 binding CD4 binding site bnAbs approach the CD4 binding site with the HCDR3 and other VH and VL loops with multiple loop-based interactions. Several different VHs and VLs are used by HCDR3 binding bnAbs with VH3 and VH4 the most common. In contrast, CD4 mimicking bnAbs have restricted VH usage and either use VH1-2*02 or VH1-46. When VH1-2*02 is used, the light chain LCDR3 must be five amino acids in length. However, when VH1-46 is used, the LCDR3 can be of normal (10-13 aa) in length. Both VH1-2*02 and VH1-46 CD4 mimicking antibodies approach the CD4 binding site in a highly homologous manner to the approach of CD4, and structural analysis of such bnAbs demonstrates both structural similarity to CD4, as well as near identical structures to each of these types of antibodies[7]. Finally, HCDR3 binders are less broad and potent than CD4 mimicking antibodies, with HCDR3 binders neutralizing ~50% of isolates (e.g., CH103, CH98) while CD4 mimickers neutralizing 90-95% of isolates (e.g., CH235.12, VRC01)[7]. Thus, both types of antibodies are desirable to induce with vaccination as components of a polyclonal bnAb response.

The CH505 African HIV-infected individual that makes both types of CD4bs bnAbs over 6 years (See Liao et al. (2013) Nature 496, 469-476 including supplementary materials; See also Gao et al. (2014) *Cell* 158:481-491; Example 8)

Thus, from African individual CH505, we have isolated both sequential Envs and bnAbs over time, and mapped the co-evolution of two bnAb lineages, the CH103 CD4 binding site HCDR3 binder bnAb lineage[11] and the CH235 CD4 mimicking CD4bs VH1-46 bnAb lineage[12]. The CH103 HCDR3 binder type of CD4 binding site antibody achieved 55% maximum breadth and 4.5 mcg inhibitory concentration 50 (IC50) neutralization of cross-clade HIVs[11]. In contrast, the CH235 CD4 mimicking CD4 binding site antibody achieved 90% neutralization and neutralizing IC50 of 0.7 mcg/ml. Here, we will describe the work of development of sequential Env regimens to induce both of these types of bnAb lineages, and propose here the new sequential Envs to specifically initiate CH235-like CD4 mimicking bnAb lineages.

The EnvSeq-1 Sequential Vaccine from CH505 Designed to Induce HCDR3-Type of CD4 Binding Site bnAbs We have developed a 4-valent immunogen comprised of CH505 envelopes that have been designed to trigger the CH103 lineage UCA to clonally expand and start off CH103-like CD4bs HCDR3-binder types of B cell lineages (TF; w053.16; w078.33; w100.B6 the EnvSeq-1 vaccine, see WO2014042669 incorporated by reference in its entirety). In SPR assays, the transmitted/founder (T/F) Env gp120 reacted with the UCA of the CH103 lineage with a $K_D$ of ~200 nM. Studies in CH103 VH+VL knock-in mice and Rhesus macaques using EnvSeq-1 have been completed and demonstrate proof of concept that sequential CH505 gp120s can initiate bnAb B cell clonal lineages in the setting of vaccination. The EnvSeq-1 vaccine binds to CH103 precursors in CH103 bnAb knock-in mice and can expand them with immunization in adjuvant. In Rhesus macaques, the gp120 EnvSeq-1 vaccine can induce antibodies with the characteristics of precursors of CD4 binding site bnAbs. These characteristics include antibodies that differentially bind CH505 Env but not Env with an isoleucine deletion at aa 371 that disrupts the CD4 binding site, antibodies that use similar VH4 and V13 genes to the human CH103 bnAb, and antibodies that neutralize the tier 1b T/F variant CH505 4.3 as well as some tier 2 viruses.

Utility of gp120s as Sequential Envs

Whether a native trimer is needed for this purpose or if a highly antigenic Env subunit will suffice is yet unknown, but studies in mice in basic B cell biology have demonstrated that what is important for B cell survival in the germinal center (GC) is the optimal affinity of the immunogen for the GC B cell receptor (BCR)[13,14]. A key question is whether gp120 or gp140 trimers are preferred immunogens in a sequential regimen. Emerging data have demonstrated that gp120s or their fragments can engage bnAb UCAs and expand CD4bs bnAb precursors[5,15,16]. In contrast, recent data with soluble individual trimers have demonstrated that they have only induced autologous tier 2 neutralizing antibodies against glycan-bare spots and not bnAb epitopes[17,18]. Thus, it is appropriate at this time to continue to study gp120 immunogens in man to test the hypothesis that sequential immunogens can initiate bnAb lineages. Whether boosting later in the immunization sequence with a trimeric Env will be needed will be tested in future studies.

The EnvSeq-2 Sequential Vaccine from CH505 is Designed to Induce CD4 Mimicking-Type of CD4 Binding Site bnAbs In this application we propose to extend the test of sequential Env immunizations in man for initiation of broadly neutralizing antibodies to test in a human Phase I clinical trial of a new series of CH505 Envs (the EnvSeq-2 vaccine) specifically designed to induce a more broad and potent bnAb type, the CH235-like VH1-46 utilizing CD4 mimicking broad neutralizing antibody with 90% breadth and 0.6 mcg/ml inhibitory concentration 50 (IC50).

Design of a Sequential Immunogen (EnvSeq-2) to Initiate VH1-46 CD4 Mimicking CD4 Binding Site Antibody Lineages Provided herein is a new set of immunogens based on the recent work describing the sequence of events that occurred with the development of CD4 mimicking CD4 binding site bnAb lineage, CH235[12].

From this work, a natural mutant of the CH505 T/F Env called CH505.M5 was found with one amino acid difference than the CH505 T/F strain, i.e., a single N279K change, that occurred very early on after infection; M5 binds to the CH235 UCA (~0.5 micromolar)[3]. Thus, M5 is the initiating Env for CD4 mimicking CD4 binding site antibodies in the context of the EnvSeq-2 vaccine.

Next, a set of 6 mutations at amino acids 97, 275, 278, 279, 281, and 471 in the Env binding site to the CH235 lineage (FIG. 10), that were associated with escape from early CH235 antibody lineage members from autologous CH505 viruses were identified and three additional Envs chosen based on mutations at these sites.

TABLE 14

EnvSeq-2 vaccine and key amino acid mutations as well as V5 length in vaccine Env gp120 components.

| Vaccine Env | aa97 | aa275 | aa279 | aa281 | aa471 | Env V5 length |
|---|---|---|---|---|---|---|
| CH505 M5 | K | E | T | V | G | 8 |
| CH505 30.25 | K | E | T | A | G | 10 |
| CHO505 53.35 | E | E | T | G | G | 11 |
| CH505 53.29 | K | E | T | A | E | 11 |

Importantly, the later CH235 antibody lineage members acquired the ability to recognize viruses with these 6 Env mutations, presumably due to the selection imposed by exposure to the resistance mutations in vivo. These late Ch235 antibodies (such as the most potent CH235.12 antibody) had expanded breadth due to selection for recognition of these 6 mutations.

These chosen Envs in EnvSeq-2 vaccine are not associated with the best binding of the antibodies at intermediate steps as was done for design of the EnvSeq-1 vaccine above.

Rather, as the increase in breadth at in the heterologous panel coincided with a gained capacity to recognize resistance mutations, Envs were selected based on their potential to expand CH235 antibody lineage recognition in order to tolerate these 6 key and common neutralization resistance-Env mutations. Nonetheless the selected Envs indeed had capacity to sequentially bind to lineage members (FIG. 20).

Finally, the fifth hypervariable loop (V5) region length was also a strong signature for recognition of CH505 viruses by CH235 antibodies, and early lineage members could only bind and neutralize short V5s. Longer V5s were selected by the early antibodies, and later antibodies could recognize viruses with longer V5s, which are more representative of the heterologous tier 2 HIV virus population. Thus, a final key criterion for selection of sequential Envs in the EnvSeq-2 vaccine was progressive lengthening of V5 (Table 14). Thus, the EnvSeq-2 Envs are associated with development of heterologous breadth from the CH235 UCA→CH235→CH235.9→CH235.12.

The EnvSeq-2 set of immunogens are currently begin produced in non-GMP in pre-production runs, and during year 1 of the Staged Vaccine Contract, will be tested in vitro in recombinant protein immunizations in both VH+VL humanized mice and rhesus macaques. In addition, a second set of CH505 immunogens chosen based on affinity of binding to members of the CH235 antibody lineage will be tested in similar immunization studies (a vaccine called EnvSeq-3, FIG. 21).

The optimal immunogen of the two sets of sequential Envs following comparison of EnvSeq-2 versus EnvSeq-3 will be chosen for GMP production in preclinical studies based on the following criteria:

a) highest level of induction of memory B cell antibodies that bind to CH505 Env and do not bind to CH505 Env with an isoleucine deletion at amino acid position 371 that disrupts the CD4 binding site (called "differential binding" memory B cells), b) no neutralization of the tier 2 CH505 T/F virus (the CH235 UCA does not neutralize the CH505 tier 2 TF virus. However, if the induced antibodies do neutralize the tier 2 TF CH505 virus, then it will be an indication of immunogen driving a CH235 lineage further into lineage maturation).

c) highest level of neutralization of the tier 1b CH505 T/F variant 4.3, d) highest level of heterologous primary HIV strain neutralizing antibodies induced.

In summary, provided are two selections of CH505 envelopes—FIG. 20 (EnvSeq-2) or FIG. 21(EnvSeq-3)—for use in immunization regimens. In some embodiments these are used as recombinant CH505 Env gp120s (including gp120 delta N)), to be used in sequence following the administration of the CH505 M5 priming Env that binds to the CH235 UCA. In other embodiments these are used in any other suitable form, for example but not limited to stable SOSIP trimer designs, gp145s, gp140s, both cleaved and uncleaved, gp140 Envs with the deletion of the cleavage (C) site, fusion (F) and immunodominant (I) region in gp41—named as gp140ΔCFI (g140CFI), gp140 Envs with the deletion of only the cleavage (C) site and fusion (F) domain—named as gp140ΔCF (gp140CF), gp140 Envs with the deletion of only the cleavage (C)—named gp140AC (gp140C) (See e.g. Liao et al. Virology 2006, 353, 268-282), gp150s, gp41s, which are readily derived from the nucleic acid and amino acid gp160 sequences.

References for Example 6:

1 Mascola, J. R. & Haynes, B. F. HIV-1 neutralizing antibodies: understanding nature's pathways. *Immunological reviews* 254, 225-244, doi:10.1111/imr.12075 (2013).

2 Haynes, B. F., Kelsoe, G., Harrison, S. C. & Kepler, T. B. B-cell-lineage immunogen design in vaccine development with HIV-1 as a case study. *Nature biotechnology* 30, 423-433, doi:10.1038/nbt.2197 (2012).

3 Haynes, B. F. & Verkoczy, L. AIDS/HIV. Host controls of HIV neutralizing antibodies. *Science* 344, 588-589, doi:10.1126/science.1254990 (2014).

4 Jardine, J. et al. Rational HIV immunogen design to target specific germline B cell receptors. *Science* 340, 711-716, doi:10.1126/science.1234150 (2013).

McGuire, A. T. et al. Engineering HIV envelope protein to activate germline B cell receptors of broadly neutralizing anti-CD4 binding site antibodies. *The Journal of experimental medicine* 210, 655-663, doi:10.1084/jem.20122824 (2013).

6 Morris, L. et al. Isolation of a human anti-HIV gp41 membrane proximal region neutralizing antibody by antigen-specific single B cell sorting. *PloS one* 6, e23532, doi:10.1371/journal.pone.0023532 (2011).

7 Zhou, T. et al. Structural Repertoire of HIV-1-Neutralizing Antibodies Targeting the CD4 Supersite in 14 Donors. *Cell* 161, 1280-1292, doi:10.1016/j.cell.2015.05.007 (2015).

8 Bonsignori, M. et al. Analysis of a clonal lineage of HIV-1 envelope V2/V3 conformational epitope-specific broadly neutralizing antibodies and their inferred unmutated common ancestors. *Journal of virology* 85, 9998-10009, doi:10.1128/JVI.05045-11(2011).

9 Andrabi, R. et al. Identification of Common Features in Prototype Broadly Neutralizing Antibodies to HIV Envelope V2 Apex to Facilitate Vaccine Design. *Immunity* 43, 959-973, doi:10.1016/j.immuni.2015.10.014 (2015).

Gorman, J. et al. Structures of HIV-1 Env V1V2 with broadly neutralizing antibodies reveal commonalities that enable vaccine design. *Nature structural & molecular biology* 23, 81-90, doi:10.1038/nsmb.3144 (2016).

11 Liao, H. X. et al. Co-evolution of a broadly neutralizing HIV-1 antibody and founder virus. *Nature* 496, 469-476, doi:10.1038/nature12053 (2013).

12 Bonsignori, M. et al. Maturation Pathway from Germline to Broad HIV-1 Neutralizer of a CD4-Mimic Antibody. *Cell* 165, 449-463, doi:10.1016/j.cell.2016.02.022 (2016).

13 Dal Porto, J. M., Haberman, A. M., Kelsoe, G. & Shlomchik, M. J. Very low affinity B cells form germinal centers, become memory B cells, and participate in secondary immune responses when higher affinity competition is reduced. *The Journal of experimental medicine* 195, 1215-1221 (2002).

14 Shih, T. A., Meffre, E., Roederer, M. & Nussenzweig, M. C. Role of BCR affinity in T cell dependent antibody responses in vivo. *Nature immunology* 3, 570-575, doi:10.1038/ni803 (2002).

McGuire, A. T. et al. Specifically modified Env immunogens activate B-cell precursors of broadly neutralizing HIV-1 antibodies in transgenic mice. *Nature communications* 7, 10618, doi:10.1038/ncomms10618 (2016).

16 Jardine, J. G. et al. HIV-1 broadly neutralizing antibody precursor B cells revealed by germline-targeting immunogen. *Science* 351, 1458-1463, doi:10.1126/science.aad9195(2016).

17 Sanders, R. W. et al. HIV-1 VACCINES. HIV-1 neutralizing antibodies induced by native-like envelope trimers. *Science* 349, aac4223, doi:10.1126/science.aac4223 (2015).

18 Bradley, T. et al. Structural Constraints of Vaccine-Induced Tier-2 Autologous HIV Neutralizing Antibodies Targeting the Receptor-Binding Site. *Cell reports* 14, 43-54, doi:10.1016/j.celrep.2015.12.017 (2016).

Example 6A: Vaccine Antigen Design Based on the Evolution of Breadth of the CH235 bNAb Lineage Four CH505 Vaccine Candidates Based on the Evolution of Breadth of the CH235 Lineage, Targeting the CD4bs The mutant called CH505.M5 is the starting point for identifying CH505 vaccine candidates. CH505.M5 is one amino acid different than the CH505 TF strain, with a single N279K change, that occurred very early and conferred resistance to the cooperating CH103 lineages.

Identification of Signature Sites in the Contact Surface of the Antibody (<8.5 A)

Mutational patterns in the signature sites in the contact surface of the antibody are determined (in the global Tier II panel, as well as in our subjects). These sites are related to heterologous and autologous neutralization sensitivity/resistance signatures. The pattern of critical interest is the set of mutations (in this case, 6 positions with mutations that are common in the circulating population) that were associated with a high degree of resistance in the heterologous population to early CH235 lineage members, but that were less restrictive for late lineage members. These amino acids were also associated with a high degree of resistance to early antibodies among CH505's Envs, and so escape in the autologous population. Later lineage members acquired the ability to recognize these mutations, presumably due to the selection imposed by exposure to the resistance mutations in vivo. These late antibodies then had expanded breadth at the population level, presumably due to selection for recognition of these mutations.

These amino acids are not associated with the best binding of the antibodies at intermediate steps (earlier hypotheses for selecting Envs was to simply pick those that bound best to intermediate linage members). As the increase in breadth in the heterologous panel coincides with a gained capacity to recognize resistance mutations, Envs are picked based on their potential to expand Ab recognition to tolerate common resistance mutations and also to require Envs that had at least some capacity to bind to lineage members, but placing emphasis on covering common signatures, not on highest binders.

Hypervariable V5 region length was also a strong signature for recognition, and early lineage members could only see short V5's. Longer V5s were selected by the early antibodies, and later antibodies could recognize viruses with longer V5s, which are more representative of the heterologous population.

The mutations conferring viral escape (or relative resistance) from early lineage antibodies are educating the later antibodies.

Later antibodies in the lineage gain breadth at the population level because they evolved the capacity to recognize particular resistance conferring amino acids that arose in vivo.

Envs that are associated with jump in breadth from the UCA→CH235→CH235.9→CH235.12 are defined. The amino acids that are statistically most closely associated with distinct increases in breadth, the heterologous signatures, are identified. These signatures are related back to cycles of escape/recognition in vivo—exposure to these signature amino acids seems to trigger the increase breadth. FIG. 35 shows the heterologous panel heatmap of IC50s for CH235UCA, CH235, CH235.9, CH235.12, and VRC01 for 202 Envs.

Mutations that are common in the circulating population and are heterologous signatures are shown on the right of FIG. 36. The 207 M group panel is grouped by bNAb sensitivity—antibodies marked with an asterisk are sensitive. Selected based only on CH235 lineage signatures at the population level, the env mutations in subject CH505 are shown in the left of FIG. 36. These contact signature amino acids are enriched among viruses that are resistance to CH235 and and CH235.9, and sensitive to CH235.12.

Envs from CH505 that carried the signature mutations were picked, requiring at least some binding of later antibodies to the antigens and that they carried modest increases in V5 length relative to M5 (FIG. 38). M5 was the best trigger for CH235 like antibodies. Env30.25 gave a gentle nudge towards the most common mutations at the population level, where CH505 TF differed from consensus. An increase in V5 length is present. Env53.25 increase the V5 length, and adds three other relatively common mutations. Env 53.29 adds 471E, that may inhibit CH235.9 binding, but CH235.12 can recognized viruses with 471E. None of the CH235 Envs tested with the E275K mutation bound any of the CH235 lineages, they were not included in the set. As there is no binding data, T278S comes up too late be included in the set.

Although CH235.12 binds Envs that carry K97E and G471E with low affinity, the differential capacity to recognize heterologous Envs between CH235.9 and CH235.12 is very strongly associated with CH235.12's ability to recognize Envs that have an E in either one of those 2 positions, so including them here may enable selection of antibodies that can recognize these quite common mutations at the population level, that restrict CH235's early lineage member's breadth (FIG. 39).

A main difference between the choice of CH505 immunogens in FIG. 40 (Selection F) and Selection G is in signature position 97 and 471. These are invariant among these six strains, with K97 and G471. But each has an E among the antigens selected on FIG. 38.

Example 7: Animal Studies

The immunogens of the invention, for example Selection F (M5, M11, 20.14, 30.20, 30.12, 136.B18) could be tested in any suitable non-human animal model. Immune responses, including B cell and T cell responses to the vaccine, could be measured by any suitable assay and criteria, such as but non limited plasma neutralization, plasma binding to vaccine and/or heterologous envelopes and/or viruses could be measured. Animals studies with various forms of the selected immunogens are contemplated: gp160 mRNA of M5, M11, 20.14, 30.20, 30.12, 136.B18 (NHP #141), 6-valent M5, M11, 20.14, 30.20, 30.12, 136.B18 as SOSIP trimers (NHP #142), mRNA of 6-valent stabilized SOSIP trimers of M5, M11, 20.14, 30.20, 30.12, 136.B18 (NHP #140), gp145DNA of CH505M5 and CH505M11 as a prime and a subsequence boost(s), followed by 6-valent M5, M11, 20.14, 30.20, 30.12, 136.B18 SOSIP trimers (e.g. NHP #139). In some embodiments the SOSIP trimer is SOSIP v4.1. Any other trimer design is contemplated. Any suitable adjuvant could be used. Studies could be performed in any suitable animal model. Studies could be performed in adults and neonates.

TABLE 15

NHP Study #139: gp145 DNA M5 + M11(x2) + 6-valent 4.1 SOSIP in neonates.

| Bleed Date | Receive @ BIDMC | Instructions (I.D. Immunizations) | Samples Qty/Volume Needed | Done at receiving laboratory |
|---|---|---|---|---|
| Wk 0 | Wk 0 **Prebleed Processed at Bioqual | Bleed + Immunize neonates only: M5 gp 145 DNA (2 mg) + M11 gp 145 DNA (2 mg) IM | EDTA+ +Stool + Rectal swabs + saliva +IDEXX serum chems + CBC | Freeze plasma in 250 uL aliquots *Bioqual to freeze Wk 0 samples |
| Wk 2 | Wk 2 | Bleed all animals | EDTA+ +Stool + Rectal swabs + saliva +IDEXX serum chems + CBC | Freeze plasma in 250 uL aliquots |
| Wk 4 | Wk 4 | Immunize neonates only: M5 gp 145 DNA (2 mg) + M11 gp 145 DNA (2 mg) IM | Stool + Rectal swabs + saliva | |
| Wk 6 | Wk 6 | Bleed all animals | EDTA+ +Stool + Rectal swabs + saliva +IDEXX serum chems + CBC | Freeze plasma in 250 uL aliquots; all PBMCs |
| Wk 8 | Wk 8 | Immunize neonates only: M5 SOSIP 4.1 stable trimer (25 ug) + M11 SOSIP 4.1 stable trimer (25 ug) In Poly ICLC (Hiltonol) = 200 ug IM | Stool + Rectal swabs + saliva | |
| Wk 10 | Wk 10 | Bleed all animals | EDTA+ +Stool + Rectal swabs + saliva +IDEXX serum chems + CBC | Freeze plasma in 250 uL aliquots; all PBMCs |
| Wk 12 | Wk 12 | Immunize neonates only: 20.14 SOSIP 4.1 stable trimer (50 ug) In Poly ICLC (Hiltonol) = 200 ug IM | Stool + Rectal swabs + saliva | |
| Wk 14 | Wk 14 | Bleed all animals | EDTA + SST +Stool + Rectal swabs + saliva +IDEXX serum chems + CBC | Freeze serum and plasma in 250 uL aliquots; all PBMCs |
| Wk 16 | Wk 16 | Immunize neonates only: 30.20 SOSIP 4.1 stable trimer (50 ug) In Poly ICLC (Hiltonol) = 200 ug IM | Stool + Rectal swabs + saliva | |
| Wk 18 | Wk 18 | Bleed all animals | EDTA + SST +Stool + Rectal swabs + saliva +IDEXX serum chems + CBC | Freeze serum and plasma in 250 uL aliquots; all PBMCs |
| Wk 20 | Wk 20 | Immunize neonates only: 30.12 SOSIP 4.1 stable trimer In Poly ICLC (Hiltonol) = 200 ug IM | Stool + Rectal swabs + saliva | |
| Wk 22 | Wk 22 | Bleed all animals | EDTA + SST +Stool + Rectal swabs + saliva +IDEXX serum chems + CBC | Freeze serum and plasma in 250 uL aliquots |
| Wk 24 | Wk 24 | Immunize neonates only: 136.B8 SOSIP 4.1 stable trimer In Poly ICLC (Hiltonol) = 200 ug IM | Stool + Rectal swabs + saliva | |
| Wk 26 | Wk 26 | Bleed all animals | EDTA + SST +Stool + Rectal swabs + saliva +IDEXX serum chems + CBC | Freeze serum and plasma in 250 uL aliquots |

TABLE 16

| NHP study #140: mRNA 6-valent chimeric stabilized 4.1 trimers | | | | |
|---|---|---|---|---|
| Bleed Date | Receive @ BIDMC | Instructions (I.D. Immunizations) | Samples Qty/Volume Needed | Done at BIDMC |
| Pre-bleed Feb. 22, 2017 | Pre-bleed Feb. 23, 2017 | Pre-LN biopsy (axillary)<br>Pre-Bleed all animals and ship to Linh Mach at BIDMC via Fedex priority overnight<br>NHP's:<br>150796, 150798, 150794, 150252 | 6 ml EDTA + 2 ml SST +serum chemistry (IDEXX) + CBC (IDEXX) | Freeze Plasma and serum in 250 uL aliquots; all PBMC |
| Wk 0 Feb. 28, 2017 | Wk 0 Feb. 29, 2017 | Bleed all animals and immunize:<br>M5 chimeric stabilized trimer (kos) mRNA-LNP 50 ug +<br>M11 chimeric stabilized trimer (kos) mRNA-LNP 50 ug<br>ID = 10 sites on the back<br>Give M5 and M11 separately at different sites to avoid heterotrimers<br>mRNA-LNPs:<br>*diluted in calcium and magnesium free PBS where needed.<br>*once thawed are stored on ice and administered within 2 hours<br>NHP's:<br>150796, 150798, 150794, 150252 | No sampling | No sampling |
| Wk 1 Mar. 7, 2017 | Wk 1 Mar. 8, 2017 | Bleed all animals<br>LN biopsy (inguinal) | 6 ml EDTA + 2 ml SST +serum chemistry (IDEXX) + CBC (IDEXX) | Freeze Plasma and serum in 250 uL aliquots; all PBMC |
| Wk 2 Mar. 14, 2017 | Wk 2 Mar. 15, 2017 | Bleed all animals | 6 ml EDTA + 2 ml SST +serum chemistry (IDEXX) + CBC (IDEXX) | Freeze serum and plasma in 250 uL aliquots; all PBMCs |
| Wk 4 Mar. 29, 2017 | Wk 4 Mar. 30, 2017 | Bleed all animals and immunize:<br>20.14 chimeric stabilized trimer (kos) mRNA-LNP 50 ug<br>ID = 10 sites on the back | 6 ml EDTA + 2 ml SST +serum chemistry (IDEXX) + CBC (IDEXX) | Freeze serum and plasma in 250 uL aliquots; all PBMCs |
| Wk 5 Apr. 5, 2017 | Wk 5 Apr. 6, 2017 | Bleed all animals<br>LN biopsy (inguinal) | 6 ml EDTA + 2 ml SST +serum chemistry (IDEXX) + CBC (IDEXX) | Freeze serum and plasma in 250 uL aliquots; all PBMCs |
| Wk 6 Apr. 12, 2017 | Wk 6 Apr. 13, 2017 | Bleed all animals | 6 ml EDTA + 2 ml SST +serum chemistry (IDEXX) + CBC (IDEXX) | Freeze serum and plasma in 250 uL aliquots; all PBMCs |
| Wk 8 Apr. 26, 2017 | Wk 8 Apr. 27, 2017 | Bleed all animals and immunize:<br>30.20 chimeric stabilized trimer (kos) mRNA-LNP 50 ug<br>ID = 10 sites on the back | 6 ml EDTA + 2 ml SST +serum chemistry (IDEXX) + CBC (IDEXX) | Freeze serum and plasma in 250 uL aliquots; all PBMCs |
| Wk 9 May 3, 2017 | Wk 9 May 4, 2017 | Bleed all animals | 6 ml EDTA + 2 ml SST +serum chemistry (IDEXX) + CBC (IDEXX) | Freeze serum and plasma in 250 uL aliquots; all PBMCs |
| Wk 10 May 10, 2017 | Wk 10 May 11, 2017 | Bleed all animals | 6 ml EDTA + 2 ml SST +serum chemistry (IDEXX) + CBC (IDEXX) | Freeze serum and plasma in 250 uL aliquots; all PBMCs |
| Wk 12 May 24, 2017 | Wk 12 May 25, 2017 | Bleed all animals and immunize:<br>30.12 chimeric stabilized trimer (kos) mRNA-LNP 50 ug<br>ID = 10 sites on the back | 6 ml EDTA + 2 ml SST +serum chemistry (IDEXX) + CBC (IDEXX) | Freeze serum and plasma in 250 uL aliquots; all PBMCs |

TABLE 16-continued

NHP study #140: mRNA 6-valent chimeric stabilized 4.1 trimers

| Bleed Date | Receive @ BIDMC | Instructions (I.D. Immunizations) | Samples Qty/Volume Needed | Done at BIDMC |
|---|---|---|---|---|
| Wk 13 May 31, 2017 | Wk 13 Jun. 1, 2017 | Bleed all animals | 6 ml EDTA + 2 ml SST +serum chemistry (IDEXX) + CBC (IDEXX) | Freeze serum and plasma in 250 uL aliquots; all PBMCs |
| Wk 14 Jun. 7, 2017 | Wk 14 Jun. 8, 2017 | Bleed all animals | 6 ml EDTA + 2 ml SST +serum chemistry (IDEXX) + CBC (IDEXX) | Freeze serum and plasma in 250 uL aliquots; all PBMCs |
| Wk 16 Jun. 21, 2017 | Wk 16 Jun. 22, 2017 | Bleed all animals and immunize: 136.B18 chimeric stabilized trimer (kos) mRNA-LNP 50 ug ID = 10 sites on the back | 6 ml EDTA + 2 ml SST +serum chemistry (IDEXX) + CBC (IDEXX) | Freeze serum and plasma in 250 uL aliquots; all PBMCs |
| Wk 17 Jun. 28, 2017 | Wk 17 Jun. 29, 2017 | Bleed all animals LN biopsy (axillary) | 6 ml EDTA + 2 ml SST +serum chemistry (IDEXX) + CBC (IDEXX) | Freeze serum and plasma in 250 uL aliquots; all PBMCs |
| Wk 18 Jul. 5, 2017 | Wk 18 Jul. 6, 2017 | Bleed all animals | 6 ml EDTA + 2 ml SST +serum chemistry (IDEXX) + CBC (IDEXX) | Freeze serum and plasma in 250 uL aliquots; all PBMCs |
| Wk 20 Jul. 19, 2017 | Wk 20 Jul. 20, 2017 | Bleed all animals | 6 ml EDTA + 2 ml SST +serum chemistry (IDEXX) + CBC (IDEXX) | Freeze serum and plasma in 250 uL aliquots; all PBMCs |
| Wk 24 Aug. 2, 2017 | Wk 24 Aug. 3, 2017 | Bleed all animals | 6 ml EDTA + 2 ml SST +serum chemistry (IDEXX) + CBC (IDEXX) | Freeze serum and plasma in 250 uL aliquots; all PBMCs |
| Wk 28 Aug. 16, 2017 | Wk 28 Aug. 17, 2017 | Bleed all animals | 6 ml EDTA + 2 ml SST +serum chemistry (IDEXX) + CBC (IDEXX) | Freeze serum and plasma in 250 uL aliquots; all PBMCs |

The mRNA immunogens are delivered by a lipid nanoparticle (LNP) technology. The LNPs comprises four different lipids that could self assemble to 80-100 nm size particles.

TABLE 17

NHP Study #141: mRNA 6-valent gp 160 membrane bound trimers

| Bleed Date | Receive @ BIDMC | Instructions (I.D. Immunizations) | Samples Qty/Volume Needed | Done at receiving laboratory |
|---|---|---|---|---|
| Wk 0 Nov. 9, 2016 | Wk 0 Nov. 10, 2016 | Pre-LN biopsy (axillary) Immunize all 4 animals: 4 NHPs (4 NOTchallenged monkeys from #129 vaccinated): 6858(M), 150250(F), 150793(M), 150795(M) M5 gp 160 membrane bound trimer mRNA-LNP 50 ug + M11 gp 160 membrane bound trimer mRNA-LNP 50 ug | Pre-LN biopsy (axillary 4 ml EDTA + 2 ml SST | Freeze serum and plasma in 250 uL aliquots |

TABLE 17-continued

NHP Study #141: mRNA 6-valent gp 160 membrane bound trimers

| Bleed Date | Receive @ BIDMC | Instructions (I.D. Immunizations) | Samples Qty/Volume Needed | Done at receiving laboratory |
|---|---|---|---|---|
| | | ID = 60 ul × 10 sites on the back Give M5 and M11 separately at different sites to avoid heterotrimers mRNA-LNPs: *diluted in calcium and magnesium free PBS where needed. *once thawed are stored on ice and administered within 2 hours | | |
| Wk 1 Nov. 16, 2016 | Wk 1 Nov. 17, 2016 | Bleed all animals + Draining lymph node biopsies (axillary) | 2 ml EDTA + Draining lymph node biopsies (axillary) | Freeze plasma in 250 uL aliquots |
| Wk 2 Nov. 21, 2016 | Wk 2 Nov. 22, 2016 | Bleed all animals | 6 ml EDTA + 2 ml SST | Freeze serum and plasma in 250 uL aliquots; all PBMCs |
| Wk 4 Dec. 6, 2016 | Wk 4 Dec. 7, 2016 | Bleed all animals and immunize: 20.14 gp 160 membrane bound trimer mRNA-LNP 50 ug ID = 60 ul × 10 sites on the back | 4 ml EDTA + 2 ml SST | Freeze serum and plasma in 250 uL aliquots |
| Wk 5 Dec. 13, 2016 | Wk 5 Dec. 14, 2016 | Bleed all animals + Draining lymph node biopsies (inguinal) | 3 ml EDTA + Draining lymph node biopsies (inguinal) | Freeze serum and plasma in 250 uL aliquots; all PBMCs |
| Wk 6 Dec. 20, 2016 | Wk 6 Dec. 21, 2016 | Bleed all animals | 3 ml EDTA + 2 ml SST | Freeze serum and plasma in 250 uL aliquots; all PBMCs |
| Wk 7 Dec. 27, 2016 | Wk 7 Dec. 28, 2016 | Bleed all animals | 3 ml EDTA | Freeze plasma in 250 uL aliquots; all PBMCs |
| Wk 8 Jan. 4, 2017 | Wk 8 Jan. 5, 2017 | Bleed all animals and immunize: 30.20 gp 160 membrane bound trimer mRNA-LNP 50 ug ID = 60 ul × 10 sites on the back | 4 ml EDTA + 2 ml SST | Freeze serum and plasma in 250 uL aliquots |
| Wk 9 Jan. 11, 2017 | Wk 9 Jan. 12, 2017 | Bleed all animals | 3 ml EDTA + 2 ml SST | Freeze serum and plasma in 250 uL aliquots |
| Wk 10 Jan. 18, 2017 | Wk 10 Jan. 19, 2017 | Bleed all animals | 3 ml EDTA + 2 ml SST | Freeze serum and plasma in 250 uL aliquots; all PBMCs |
| Wk 12 Jan. 31, 2017 | Wk 12 Feb. 1, 2017 | Bleed all animals and immunize: 30.12 gp 160 membrane bound trimer mRNA-LNP 50 ug ID = 60 ul × 10 sites on the back | 4 ml EDTA + 2 ml SST | Freeze serum and plasma in 250 uL aliquots |
| Wk 13 Feb. 8, 2017 | Wk 13 Feb. 9, 2017 | Bleed all animals | 3 ml EDTA + 2 ml SST | Freeze serum and plasma in 250 uL aliquots; all PBMCs |
| Wk 14 Feb. 14, 2017 | Wk 14 Feb. 15, 2017 | Bleed all animals | 3 ml EDTA + 2 ml SST | Freeze serum and plasma in 250 uL aliquots; all PBMCs |
| Wk 16 Feb. 28, 2017 | Wk 16 Mar. 1, 2017 | Bleed all animals and immunize: 136.B18 gp 160 membrane bound trimer mRNA-LNP 50 ug ID = 60 ul × 10 sites on the back | 4 ml EDTA + 2 ml SST | Freeze serum and plasma in 250 uL aliquots |
| Wk 17 Mar. 7, 2017 | Wk 17 Mar. 8, 2017 | Bleed all animals + Draining lymph node biopsies (inguinal) | 3 ml EDTA + 1 ml SST + Draining lymph node biopsies (inguinal) | Freeze serum and plasma in 250 uL aliquots; all PBMCs |

TABLE 17-continued

| NHP Study #141: mRNA 6-valent gp 160 membrane bound trimers | | | | |
|---|---|---|---|---|
| Bleed Date | Receive @ BIDMC | Instructions (I.D. Immunizations) | Samples Qty/Volume Needed | Done at receiving laboratory |
| Wk 18 Mar. 14, 2017 | Wk 18 Mar. 15, 2017 | Bleed all animals | 3 ml EDTA + 2 ml SST | Freeze serum and plasma in 250 uL aliquots; all PBMCs |
| Wk 20 Mar. 28, 2017 | Wk 20 Mar. 29, 2017 | Bleed all animals | 4 ml EDTA + 2 ml SST | Freeze serum and plasma in 250 uL aliquots |
| Wk 24 Apr. 25, 2017 | Wk 24 Apr. 26, 2017 | Bleed all animals | 4 ml EDTA + 2 ml SST | Freeze serum and plasma in 250 uL aliquots |
| Wk 28 May 23, 2017 | Wk 28 May 24, 2017 | Bleed all animals | 4 ml EDTA + 2 ml SST | Freeze serum and plasma in 250 uL aliquots |

TABLE 18

| NHP Study #142: 6-valent chimeric stabilized trimer protein (kos) | | | | |
|---|---|---|---|---|
| Bleed Date | Receive @ BIDMC | Instructions (I.D. Immunizations) | Samples Qty/Volume Needed | Done at BIDMC |
| Feb. 22, 2017 | Feb. 23, 2017 | Pre-LN biopsy (axillary) Pre-Bleed all animals and ship to Linh Mach at BIDMC via Fedex priority overnight NHP's: 150251, 6857, T244, T245 | 6 ml EDTA + 2 ml SST +serum chemistry (IDEXX) + CBC (IDEXX) | Freeze serum and plasma in 250 uL aliquots; all PBMCs |
| Wk 0 Feb. 28, 2017 | Wk 0 Feb. 29, 2017 | Bleed all animals and immunize: NHP #: 150251, 6857, T244, T245 M5 chimeric stabilized trimer (kos) + M11 chimeric stabilized trimer (kos) IM injections | 6 ml EDTA + 2 ml SST +serum chemistry (IDEXX) + CBC (IDEXX) | Freeze serum and plasma in 250 uL aliquots; all PBMCs |
| Wk 1 Mar. 7, 2017 | Wk 1 Mar. 8, 2017 | Bleed all animals LN biopsy (inguinal) | 6 ml EDTA + 2 ml SST +serum chemistry (IDEXX) + CBC (IDEXX) | Freeze serum and plasma in 250 uL aliquots; all PBMCs |
| Wk 2 Mar. 14, 2017 | Wk 2 Mar. 15, 2017 | Bleed all animals | 6 ml EDTA + 2 ml SST +serum chemistry (IDEXX) + CBC (IDEXX) | Freeze serum and plasma in 250 uL aliquots; all PBMCs |
| Wk 4 Mar. 29, 2017 | Wk 4 Mar. 30, 2017 | Bleed all animals and immunize: 20.14 chimeric stabilized trimer (kos) | 6 ml EDTA + 2 ml SST +serum chemistry (IDEXX) + CBC (IDEXX) | Freeze serum and plasma in 250 uL aliquots; all PBMCs |
| Wk 5 Apr. 5, 2017 | Wk 5 Apr. 6, 2017 | Bleed all animals LN biopsy (inguinal) | 6 ml EDTA + 2 ml SST +serum chemistry (IDEXX) + CBC (IDEXX) | Freeze serum and plasma in 250 uL aliquots; all PBMCs |
| Wk 6 Apr. 12, 2017 | Wk 6 Apr. 13, 2017 | Bleed all animals | 6 ml EDTA + 2 ml SST +serum chemistry (IDEXX) + CBC (IDEXX) | Freeze serum and plasma in 250 uL aliquots; all PBMCs |

TABLE 18-continued

| NHP Study #142: 6-valent chimeric stabilized trimer protein (kos) | | | | |
|---|---|---|---|---|
| Bleed Date | Receive @ BIDMC | Instructions (I.D. Immunizations) | Samples Qty/Volume Needed | Done at BIDMC |
| Wk 8 Apr. 26, 2017 | Wk 8 Apr. 27, 2017 | Bleed all animals and immunize: 30.20 chimeric stabilized trimer (kos) | 6 ml EDTA + 2 ml SST +serum chemistry (IDEXX) + CBC (IDEXX) | Freeze serum and plasma in 250 uL aliquots; all PBMCs |
| Wk 9 May 3, 2017 | Wk 9 May 4, 2017 | Bleed all animals | 6 ml EDTA + 2 ml SST +serum chemistry (IDEXX) + CBC (IDEXX) | Freeze serum and plasma in 250 uL aliquots; all PBMCs |
| Wk 10 May 10, 2017 | Wk 10 May 11, 2017 | Bleed all animals | 6 ml EDTA + 2 ml SST +serum chemistry (IDEXX) + CBC (IDEXX)) | Freeze serum and plasma in 250 uL aliquots; all PBMCs |
| Wk 12 May 24, 2017 | Wk 12 May 25, 2017 | Bleed all animals and immunize: 30.12 chimeric stabilized trimer (kos) | 6 ml EDTA + 2 ml SST +serum chemistry (IDEXX) + CBC (IDEXX) | Freeze serum and plasma in 250 uL aliquots; all PBMCs |
| Wk 13 May 31, 2017 | Wk 13 Jun. 1, 2017 | Bleed all animals | 6 ml EDTA + 2 ml SST +serum chemistry (IDEXX) + CBC (IDEXX) | Freeze serum and plasma in 250 uL aliquots; all PBMCs |
| Wk 14 Jun. 7, 2017 | Wk 14 Jun. 8, 2017 | Bleed all animals | 6 ml EDTA + 2 ml SST +serum chemistry (IDEXX) + CBC (IDEXX) | Freeze serum and plasma in 250 uL aliquots; all PBMCs |
| Wk 16 Jun. 21, 2017 | Wk 16 Jun. 22, 2017 | Bleed all animals and immunize: 136.B18 chimeric stabilized trimer (kos) | 6 ml EDTA + 2 ml SST +serum chemistry (IDEXX) + CBC (IDEXX) | Freeze serum and plasma in 250 uL aliquots; all PBMCs |
| Wk 17 Jun. 28, 2017 | Wk 17 Jun. 29, 2017 | Bleed all animals LN biopsy (axillary) | 6 ml EDTA + 2 ml SST +serum chemistry (IDEXX) + CBC (IDEXX) | Freeze serum and plasma in 250 uL aliquots; all PBMCs |
| Wk 18 Jul. 5, 2017 | Wk 18 Jul. 6, 2017 | Bleed all animals | 6 ml EDTA + 2 ml SST +serum chemistry (IDEXX) + CBC (IDEXX) | Freeze serum and plasma in 250 uL aliquots; all PBMCs |

This protocol describes NHP immunization study with M5, M11, 20.14, 30.20, 30.12, 136.B18 envelopes and SIVGag. In some embodiments the below vaccination regimen could be carried out with the proteins delivered as trimers, for example but not limited to SOSIP.III trimers.

TABLE 19

| Bleed Date | Instructions | Samples Qty/Volume Needed | Notes |
|---|---|---|---|
| Pre (−12 to −4 weeks) | Collect pre samples (−12 to −4 weeks) | Plasma, PBMC, serum, saliva, rectal swab, vaginal swab, LN (axillary) | |
| Wk 0 (EP1) | Vaccination #1: M5 + M11 Vaccine HIV env gp 145 DNA & SIV gag DNA (Conserved element CE prime | Plasma, PBMC, serum, saliva, rectal swab, vaginal swab, fecal sample | |

TABLE 19-continued

| Bleed Date | Instructions | Samples Qty/Volume Needed | Notes |
|---|---|---|---|
| | followed by C0-delivery of CE & complete gag boost) DNA dose = 2 mg of each construct<br>Protein HIV gp 120. Env dose = 200 ug of each protein<br>Adjuvant = GLA-SE 25 ug<br>Route: IM/EP Innovio<br>(n = 5)<br>Group 1A<br>Group 1B<br>Group 1C<br>Group 1D<br>DNA + Protein co-immunization (both sides) = into same muscle<br>Group 2A<br>Group 2B<br>Group 2C<br>Group 2D<br>DNA (Left side) + Protein (Right side) = separate sides and muscles<br>Group 3A<br>Group 3B<br>Sham DNA and adjuvant co-immunization (Both Sides) = same muscle<br>Group 4A<br>Group 4B<br>Treatment naive | | |
| Wk 1 (EP1wk 1) | LN G3A, G3B, G4A, G4B @ Lt only | Plasma, PBMC, serum | |
| Wk 2 (EP1 Wk 2) | | Plasma, PBMC, serum, saliva, rectal swab, vaginal swab, fecal sample | |
| Wk 8 (EP2) | Vaccination #2: 20.14<br>DNA dose = 2 mg of each construct<br>Env dose = 200 ug of each protein | Plasma, PBMC, serum | |
| Wk 9 (EP2 wk 1) | LN ing G1A, G2A @ Rt & Lt<br>LN G3A, G3B, G4A, G4B @ Rt only | Plasma, PBMC, serum | |
| Wk 10 (EP2 wk 2) | BM G1A, G2A | Plasma, PBMC, serum, saliva, rectal swab, vaginal swab, fecal sample, vaginal bx, rectal bx | |
| Wk 16 | | Plasma, PBMC, serum | |
| Wk 24 (EP3) | Vaccination #3: 30.20<br>DNA dose = 2 mg of each construct<br>Env dose = 200 ug of each protein | Plasma, PBMC, serum | |
| Wk 25 (EP3 wk 1) | LN ing G1B, G2B Rt & Lt | Plasma, PBMC, serum, | |
| Wk 26 (EP3 wk 2) | BM G1B, G2B | Plasma, PBMC, serum, saliva, rectal swab, vaginal swab, fecal sample | |
| Wk 32 | | Plasma, PBMC | |
| Wk 40 (EP 4) | Vaccination #4: 30.12<br>DNA dose = 2 mg of each construct<br>Env dose = 200 ug of each protein | Plasma, PBMC, serum | |
| Wk 41 (EP 4 wk 1) | LN ing G1C, G2C Rt & Lt | Plasma, PBMC, serum | |
| Wk 42 (EP4 wk 2) | BM G1C, G2C | Plasma, PBMC, serum, saliva, rectal swab, vaginal swab, fecal sample, vaginal bx, rectal bx | |
| Wk 48 | | Plasma, PBMC | |
| Wk 56 (EP5) | Vaccination #5: 136.B18<br>DNA dose = 2 mg of each construct<br>Env dose = 200 ug of each protein | Plasma, PBMC, serum | |
| Wk 57 (EP5 wk 1) | LN ing G1D, G2D Rt & Lt | Plasma, PBMC, serum | |
| Wk 58 (EP5 wk 2) | BM G1D, G2D<br>*Necropsy 2 animals | Plasma, PBMC, serum, saliva, rectal swab, vaginal swab, fecal sample | |
| Wk 64 | | Plasma, PBMC | |
| Wk 74 | | Plasma, PBMC, serum, saliva, rectal swab, vaginal swab, fecal sample | |

Non-limiting example of an immunization protocols with Selection F (M5, M11, 20.14, 30.20, 30.12, 136.B18). In this example the immunogens are delivered as mRNA formulated in nanoparticles. In some embodiments the stabilized trimers are of the design SOSIP.III.

Materials needed: Formulate mRNA for 6 monkeys. 6 doses×50 ug/nhp=300 ug of each mRNA construct.

Collections of Plasma, Serum, and PBMC: Collect all plasma and serum in 250 uL aliquots and save all PBMCs. CBC collection: 850 uL from each animal Animal studies using the above protocols could be carried out with the immunogens of Selection G (EnvSeq-2), or Selection H (EnvSeq-3).

Animal studies with envelopes CH505 T/F, as stable trimers are also contemplated. Non-limiting examples of such studies include: CH505 T/F as gp145 nucleic acid prime (once or twice), followed by sequential SOSIP 4.1 trimers of CH505 T/F, CH505 w53.16, CH505 w78.33, CH505 w100.B6. In some embodiments there is no nucleic acid prime and immunization regimen comprises sequential SOSIP 4.1 trimers of CH505 T/F, CH505 w53.16, CH505 w78.33, CH505 w100.B6. In some embodiments the nucleic acid is mRNA. In some embodiments the nucleic acid is DNA. In some embodiments the DNA is administered via electroporation. In some embodiments of these studies, animals could be boosted with CH505 w136.B8.

Example 8: Maturation Pathway from Germline to Broad HIV-1 Neutralizer of a CD4-Mimic Antibody Antibodies with ontogenies from $V_H$1-2 or $V_H$1-46-germline genes dominate the broadly neutralizing response against the CD4-binding site (CD4bs) on HIV-1. Here we define with longitudinal sampling from time-of-infection the development of a $V_H$1-46-derived antibody lineage that matured to neutralize 90% of HIV-1 isolates. Structures of lineage antibodies CH235 (week 41 from time-of-infection, 18% breadth), CH235.9 (week 152, 77%) and CH235.12 (week 323, 90%) demonstrated the maturing epitope to focus on the conformationally invariant portion of the CD4bs. Similarities between CH235 lineage and five unrelated CD4bs lineages in epitope focusing, length-of-time to develop breadth, and extraordinary levels of somatic hypermutation suggested commonalities in maturation among all CD4bs antibodies. Fortunately, the required CH235-lineage hypermutation appeared substantially guided by the intrinsic mutability of the $V_H$1-46 gene, which closely resembled $V_H$1-2. We integrated our CH235-lineage findings with a second broadly neutralizing lineage and HIV-1 co-evolution to suggest a vaccination strategy for inducing both lineages.

Introduction

Understanding the pathways and mechanisms of broadly neutralizing antibody (bnAb) induction is a critical goal of HIV-1 vaccine development (Bonsignori et al., 2012; Haynes, 2015; Haynes and Bradley, 2015; Haynes et al., 2012; Mascola and Haynes, 2013;). In chronic HIV-1 infections, breadth of plasma neutralization follows a uniform distribution and broad neutralization arises in ~50% of individuals after 5 years or more of infection (Hraber et al., 2014). The delayed appearance of bnAbs suggests roadblocks to their development, and one vaccine approach is to decipher these roadblocks and devise strategies to overcome them. It is possible that—because of the high diversity of antibodies resulting from recombination and somatic hypermutation (SHM)—different bnAb lineages may have different developmental pathways and roadblocks. However, for the CD4-binding site (CD4bs), a population-level analysis on 14 donors indicated only two general types of CD4bs bnAbs: $V_H$-gene restricted and CDR H3-dominated (Zhou et al., 2015).

The $V_H$-gene restricted classes arise from two highly similar $V_H$-genes: $V_H$1-2 and $V_H$1-46 (Scheid et al., 2011; Wu et al., 2011). $V_H$1-2*02 and $V_H$1-46*01 share 93.4% (269/288) nucleotide sequence identity. Both classes give rise to antibodies that recognize the CD4bs via $V_H$ structural mimicry of the immunoglobulin-like N-terminal domain of CD4 (Zhou et al., 2010; Zhou et al., 2015). For the $V_H$1-2 gene-derived antibodies, analysis of their ontogeny suggests two roadblocks based on: (i) a requirement for high levels of SHM (Klein et al., 2013; Scheid et al., 2009; Scheid et al., 2011; Wu et al., 2010), and (ii) weak binding of the inferred unmutated common ancestor (UCA) to gp120 (Jardine et al., 2013; McGuire et al., 2013; Scheid et al., 2011; Wu et al., 2011; Zhou et al., 2010; Zhou et al., 2015), although a definitive analysis from time-of-infection had not yet provided detail. In addition, several of the CD4bs bnAbs are autoreactive with ubiquitinase enzymes (Bonsignori et al., 2014; Liao et al., 2013; Liu et al., 2015).

Structure-based design of UCA-interacting immunogens has recently demonstrated a means to overcome this second roadblock, with priming of $V_H$1-2 bnAb lineages in knock-in mice (Dosenovic et al., 2015; Jardine et al., 2015). However, the maturation of primed $V_H$1-2 CD4bs B cell lineages to broad neutralization as well as the mechanism for the development of breadth remain unresolved.

For the $V_H$1-46-derived antibodies, far less is known. Two chronically HIV-infected individuals, RU1 and RU8, have developed $V_H$1-46-derived bnAbs, 1B2530 and 8ANC131 (Scheid et al., 2011). We recently described an African individual (donor CH505) who, over time, developed a CD4bs bnAb lineage (the CH103 lineage) that recognized the CD4 supersite through a CDR H3-dominated mode of interaction (Liao et al., 2013). Analysis of the co-evolution between virus and CH103 lineage demonstrated a second B cell lineage (the CH235 lineage) that cooperated by selection of escape mutants from the CH235 lineage that drove the CH103 bnAb lineage (Gao et al., 2014). Here we find that the CH235 lineage itself progressed to bnAb over 5 years of affinity maturation. We identify sequences of the CH235 lineage through longitudinal samples of 17 time points spanning weeks (wks) 6-323 post infection, assess neutralization breadth of sequential lineage members on a panel of ~200 diverse isolates, and determine Env-complexed crystal and EM structures for lineage members. We analyze the conformity (i.e. the level of shared mutation positions and identical sequence mutations) of CH235 lineage development relative to other $V_H$ gene-specific bnAb lineages in other donors, as well as the co-evolution of virus and CH235 lineage. Despite an early near-optimal binding orientation, the CH235 lineage required over 20% SHM to reach 90% neutralization breadth. Our results provide insight into the difficulties in focusing recognition to the conserved site of HIV-1 vulnerability, and suggest that CD4bs-directed antibodies, whether $V_H$-gene restricted or CDR H3-dominated, face similar obstacles in development. For $V_H$1-46- and $V_H$1-2-derived CD4-mimic antibodies, the unique genetic mutability inherent in each of these two $V_H$-germline genes helps to direct maturation, potentially providing an explanation for the prevalence of effective CD4bs antibodies derived from these two germline genes.

Results

Sequencing of B Cell Antibody Gene Rearrangements in Longitudinal Samples.

To understand the maturation of the cooperating CH235 lineage in donor CH505, we sought to identify sequences of lineage members at 17 time points, spanning wks 6 to 323 from time of infection. We first asked when we could detect members of the CH235 lineage. Next-generation sequencing (NGS) of antibody heavy chain gene rearrangements amplified from genomic DNA template of blood mononuclear cells from wk 6 to 152 (15 time points) identified a total of 479,028 unique, non-duplicated V-heavy sequences. The first V-heavy sequences belonging to the CH235 B cell lineage were found at wk 14, and additional CH235 lineage members were found at all subsequent time points. Only unique sequences in the CH235 lineage were further investigated and they were assigned to the earliest time-point (time-of-appearance) in which they were identified. Four V-heavy sequences were paired with the closest $V_L$ from isolated antibodies and produced as recombinant monoclonal antibodies (mAbs) (CH235.6 through CH235.9). From cultured memory B cells collected 41 wks post-transmission we had previously isolated five members of the CH235 lineage (CH235, CH236, CH239, CH240 and CH241) (Gao et al., 2014) and we have now isolated four additional members with natural $V_H$ and $V_L$ pairing from cultured memory B cells collected at wks 264 and 323 post-transmission: CH235.10 through CH235.13 (FIG. 41A, FIG. 48A and FIG. 53). CH235 lineage antibodies represented 0.018% of the total memory B cell repertoire and 0.5% of the CH505 TF gp120-specific memory B cell population.

The CH235 lineage could be separated into three clades (clade I, II and III). Clade I showed a number of early lineage members, but no additional clade I sequences were observed after wk 30; clade II showed further development and included members CH241 (wk 41) and CH235.6 (wk 66), but no additional sequences were observed after wk 66; clade III developed through wk 323 and included antibodies CH235 (wk 41), CH235.9 (wk 152), and CH235.12 (wk 323) (FIG. 41A).

CH235 Lineage HIV-1 Neutralization.

To characterize the development of neutralization breadth in the CH235 lineage, we assessed antibodies in clade III for their ability to neutralize diverse HIV-1 isolates in a 199-isolate panel (FIG. 41B and FIG. 54). No isolates were neutralized by the unmutated common ancestor (UCA), whereas 18% of the viruses were neutralized by CH235 at wk 41. By wk 152, CH235.9 neutralized 77% of viruses, although with a relatively weak potency of 3 μg/ml. By wk 323, however, CH235.12 was able to neutralize 90% of viruses, and the neutralization 50% inhibitory concentration ($IC_{50}$) potency increased by 5-fold to 0.6 μg/ml.

We next analyzed the heterologous neutralization pattern of these antibodies to understand their development of broad neutralization (FIG. 48B) (Georgiev et al., 2013). CH235 lineage members and previously identified HIV-1 bnAbs were clustered based on heterologous neutralization activity. CH235 neutralization activity was more similar to CD4bs bnAbs than to bnAbs with other epitope specificities. While the CH235 neutralization profile was the most divergent from other CD4bs bnAbs, CH235.9 and CH235.12 were much more similar to other CD4bs bnAbs and each other. Interestingly, despite $V_H$1-46 usage, the CH235.9 and CH235.12 neutralizing profile was more similar to that of $V_H$1-2-derived antibodies, such as VRC01, than $V_H$1-46-derived antibodies, such as 8ANC131 (FIG. 48B).

Crystal Structures of CH235-Lineage Members with HIV-1 gp120.

Figure 42A:
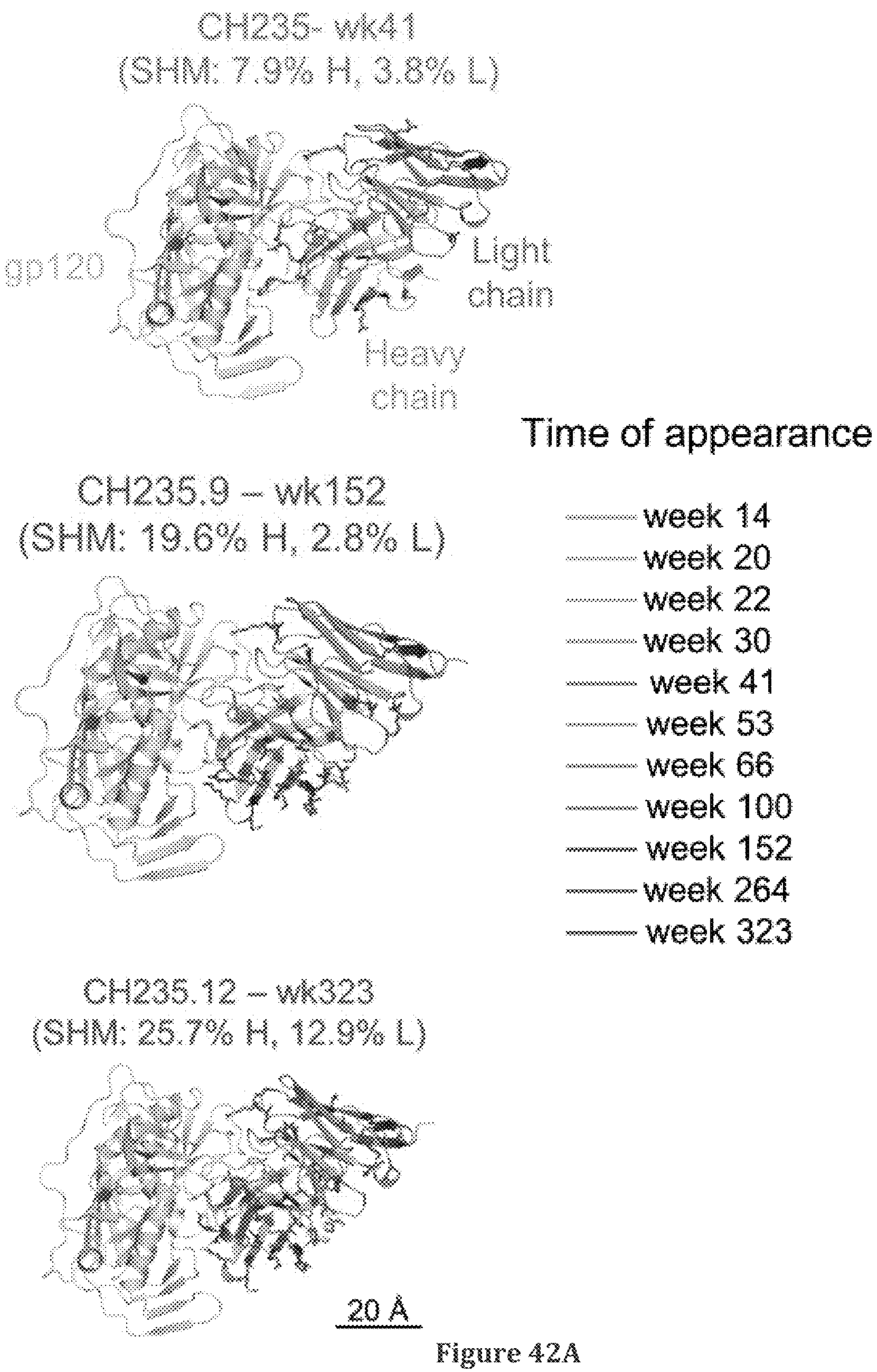

To provide structural insight into the recognition and maturation of the CH235 lineage, we prepared the antigen-binding fragments (Fabs) of antibodies CH235 (wk 41 from time of infection, 18% breadth), CH235.9 (wk 152, 77%) and CH235.12 (wk 323, 90%), and co-crystallized, solved and refined these in complex with the gp120 core of HIV-1 isolate strain (93TH057) (FIGS. 42A-E, FIG. 55). We mapped the location of residues altered during SHM and observed changes throughout the variable domain (FIG. 42A).

Figure 49A:
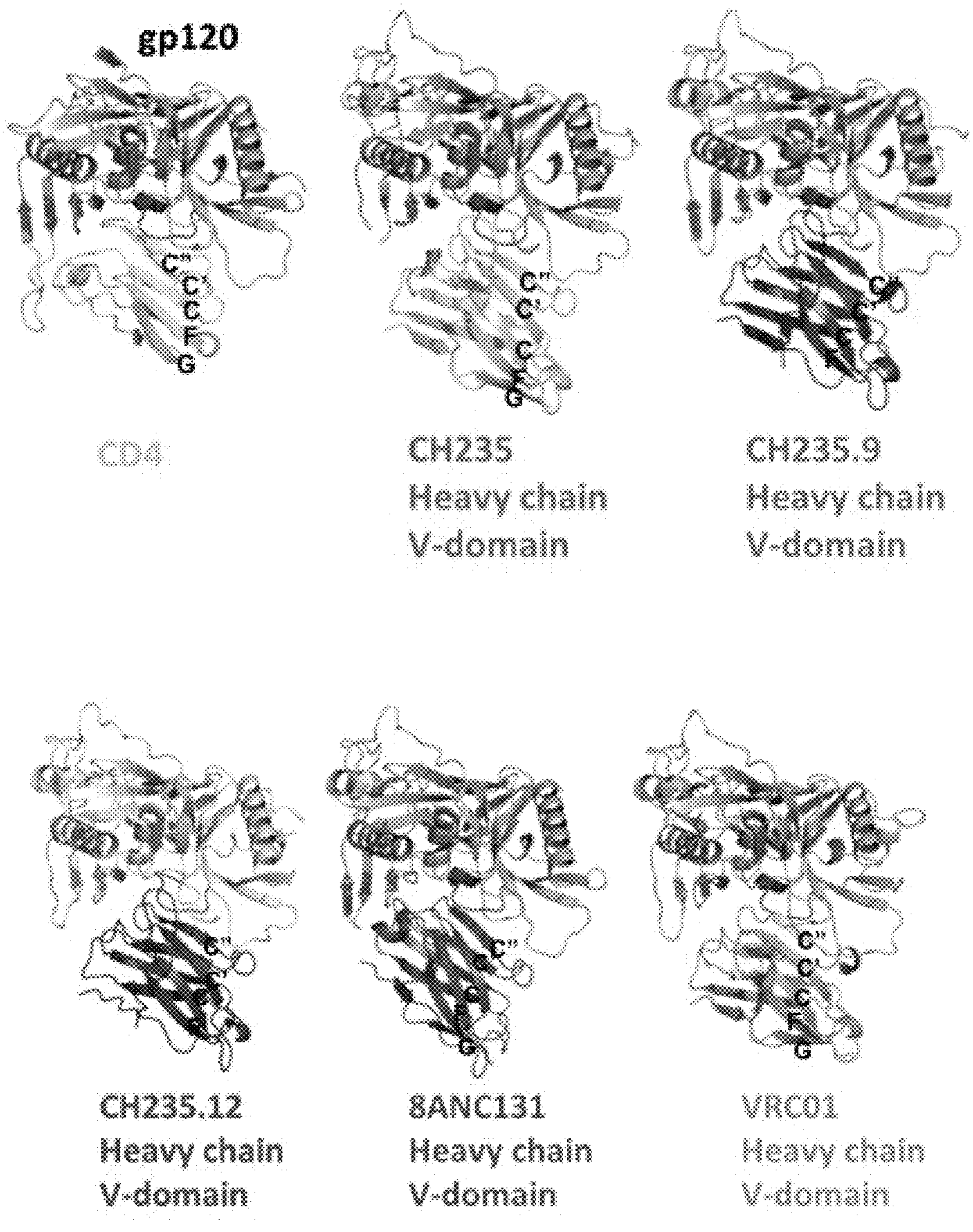
Figure 49B:
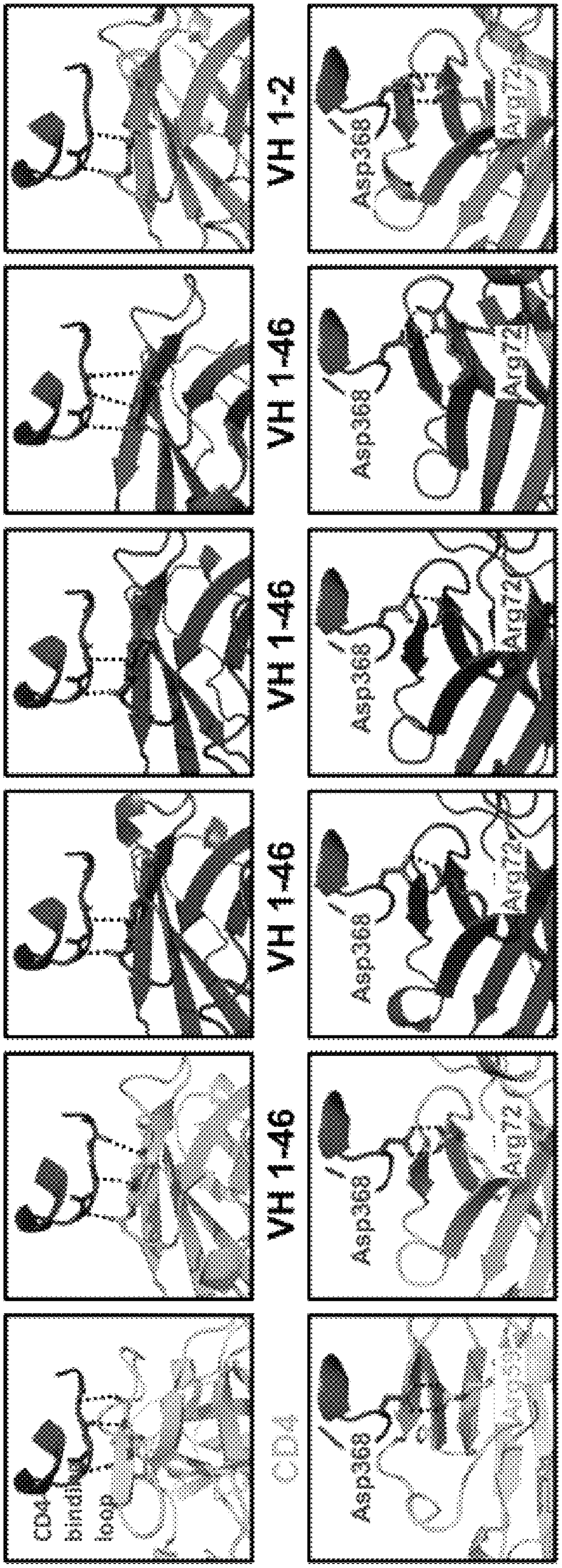

Comparison of the orientation of the $V_H$ of CH235 in Env binding with that of CD4, VRC01 and 8ANC131 (Scheid et al., 2011) showed that the CH235 $V_H$ domain mimicked CD4 in Env binding and was highly similar to the $V_H$ orientation and structure of the VRC01 and 8ANC131 $V_H$ chains: in particular, the $V_H$1-46 of CH235 preserved key contacts mediated by the CDR H2 loop for the CD4 binding loop and for the gp120 D368 (FIG. 49A,B).

Figure 49C:
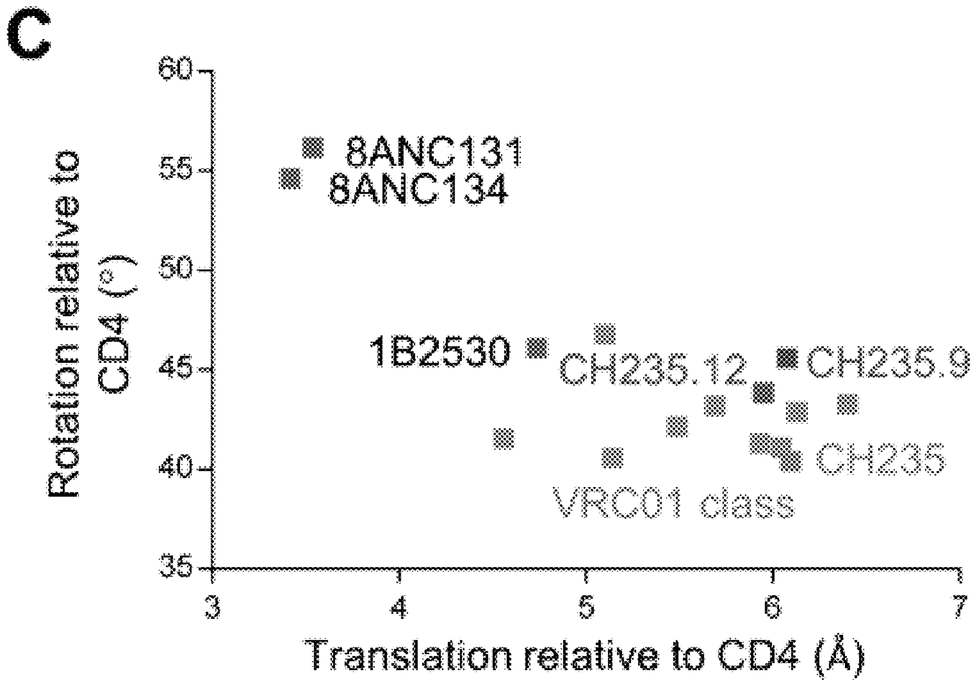
Figure 49D:
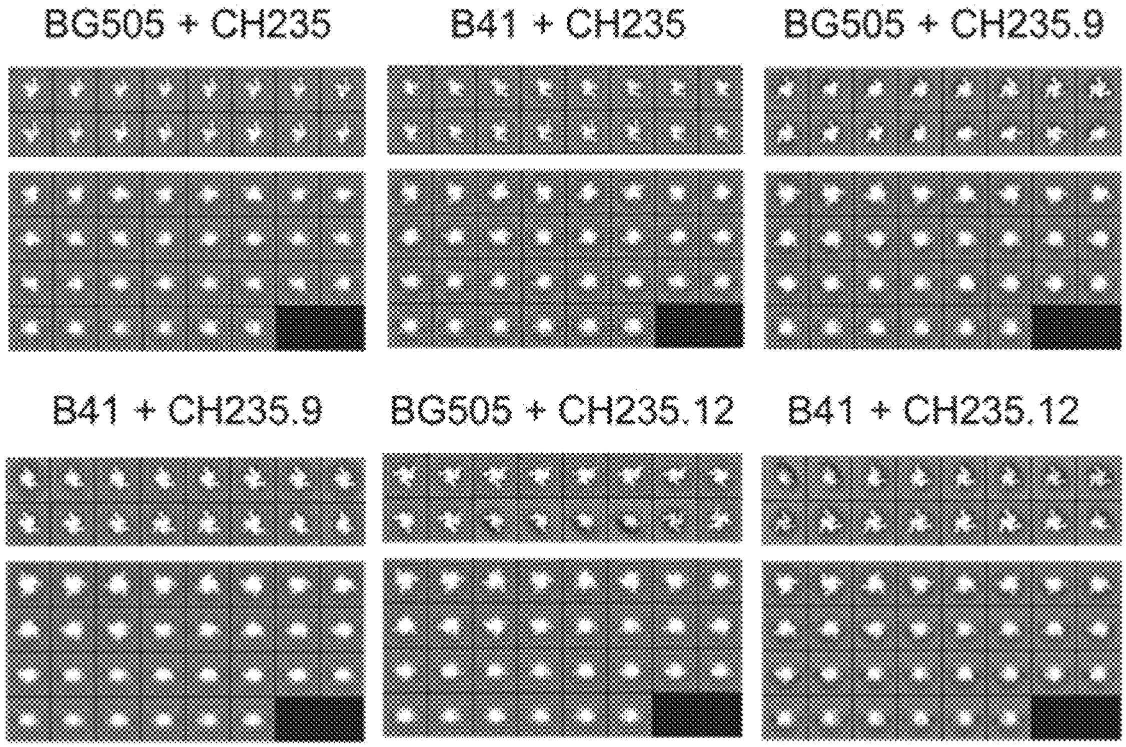
Figure 49E:
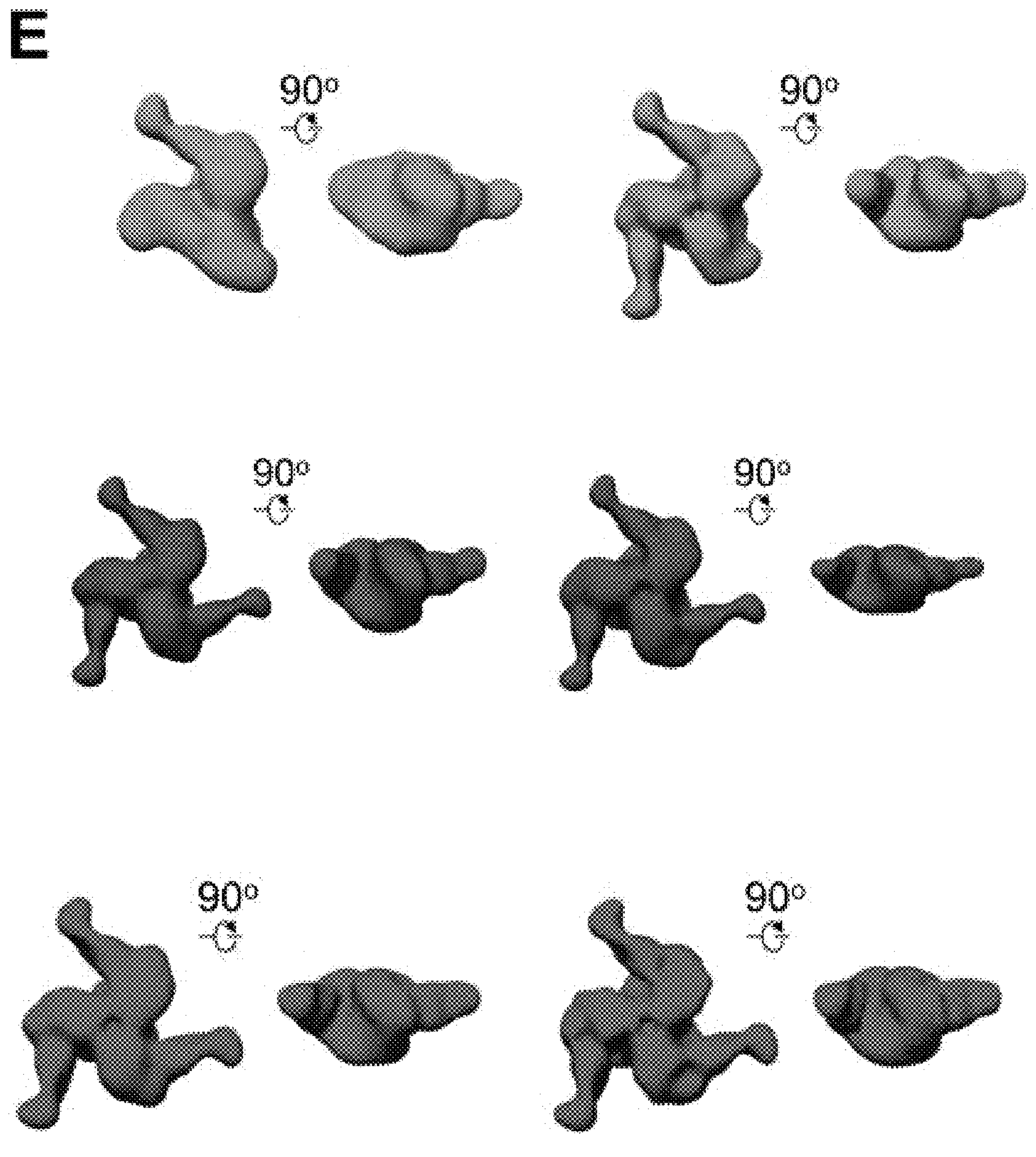
Figure 49F:
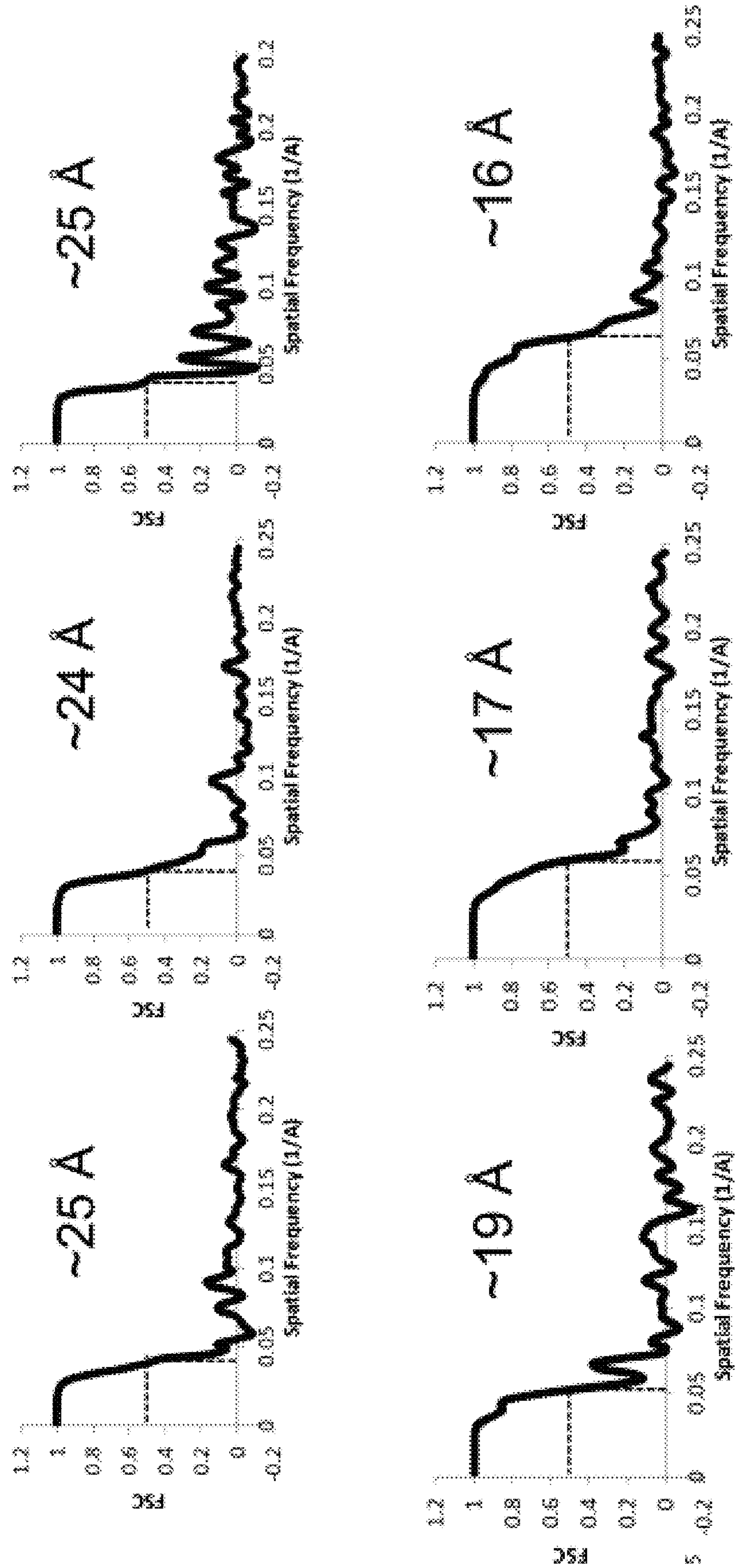

Analysis of the angle of recognition for the CH235 lineage indicated little change during maturation, with CH235, CH235.9 and CH235.12 all clustering within the larger VRC01-class of antibodies. Interestingly, other $V_H$1-46 antibodies clustered differently, with antibody 1B2530 from HIV-1-positive donor RU1 at a highly similar angle and 1.5 Å translated, and antibodies 8ANC131 and 8ANC134 from HIV-1-positive donor RU8 occupying a cluster about 55 degrees and 3.5 Å translated related to the CD4 (FIG. 49C).

These results suggest that the gp120-antibody orientation was determined early in bnAb lineage ontogeny, with further maturation maintaining the same general orientation. Overall, the structures of CH235 lineage members with HIV-1 gp120 Env revealed CD4 mimicry. While the $V_H$ gene usage classifies the CH235 lineage within the $V_H$1-46-derived 8ANC131 bnAb class, it is both functionally and structurally closer to the VRC01 class (Zhou et al., 2015).

Negative Stain EM of CH235-Lineage Members with Trimeric HIV-1 Env.

Figure 42B:
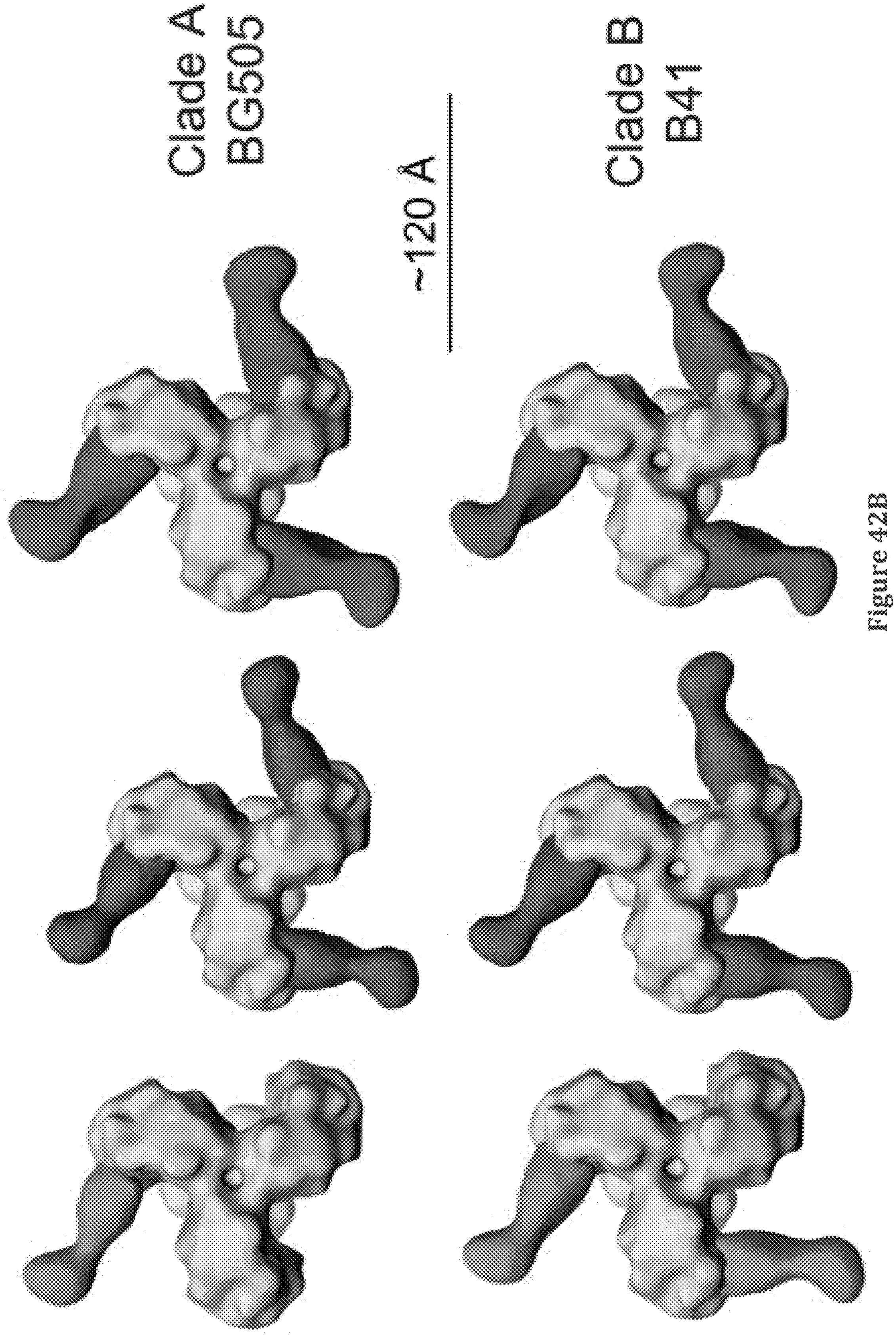
Figure 49G:
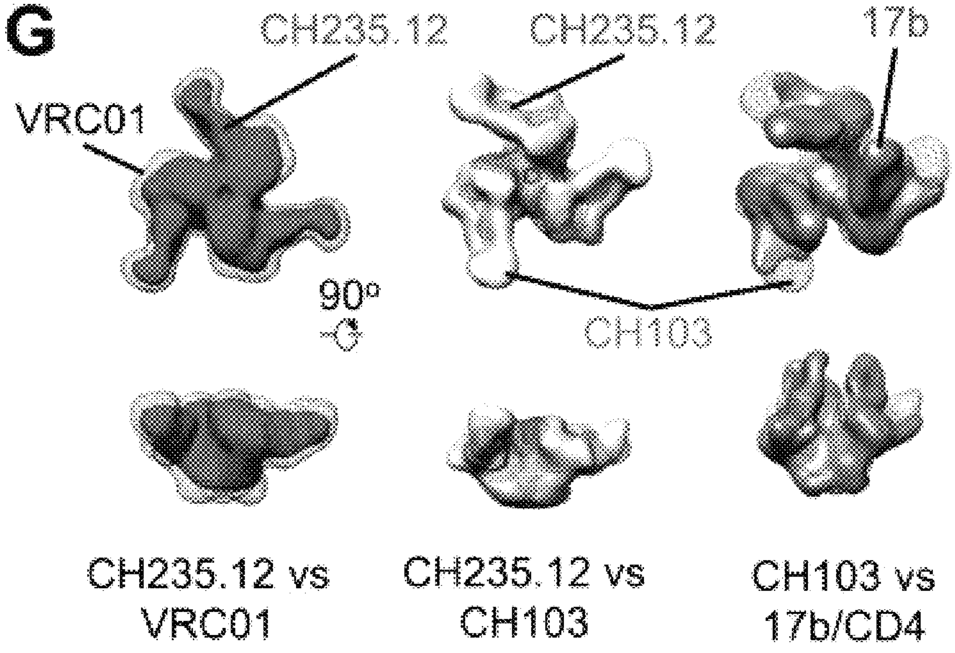

To visualize the recognition of the CH235 lineage in the context of the HIV-1 Env trimer, we used negative stain EM to determine 3D-reconstructions of Fabs CH235, CH235.9 and CH235.12 bound to trimeric BG505 and B41 HIV-1 Env glycoproteins (FIG. 42B)(Pugach et al., 2015; Sanders et al., 2013). Notably, the stoichiometry increased with antibody maturation, with CH235 (8% $V_H$ mutation) binding with a stoichiometry of 1:1 (BG505; FIG. 42B, top, FIG. 49D-F) or 2:1 (B41; FIG. 42B, bottom, FIG. 49D-F) Fabs per trimer and CH235.9 and CH235.12 (19% and 25% $V_H$ mutation, respectively) binding with a 3:1 Fab to trimer ratio (FIG. 42B). We next compared the orientation and stoichiometry of CH235.12 Fab with that of CH103, a CDR H3-dependent CD4bs bnAb isolated from the same subject (Liao et al., 2013). EM analysis of either CH235.12 or CH103 Fab in complex with BG505 SOSIP.664 revealed structural differences between the CDR H3-dominated CH103 class bnAb and the 8ANC131-class CH235.12 bnAb and, in accordance with crystallographic results, the angle of approach of CH235 was similar to that of VRC01 and other CD4 mimicking bnAbs (FIG. 49G).

Despite the CD4 mimicry by CH235, the trimer remained in a closed conformation when the CH235 lineage members were bound. However, the EM-derived model of CH103 in complex with BG505 revealed that CH103 either bound to or induced a more open version of the trimer. This conformation represents an intermediate state between the closed, compact trimer in complex with CH235 or VRC01, and the CD4-induced open model in complex with soluble CD4 or 17b Fab (FIG. 49G). Similar to more mature CH235 lineage bnAb Fabs, bnAb CH103 bound to BG505 with a stoichiometry of 3 Fabs per trimer. (FIG. 49G).

Maturation Focuses CH235 Lineage Recognition to a Conserved Site of CD4 Vulnerability.

Figure 42C:
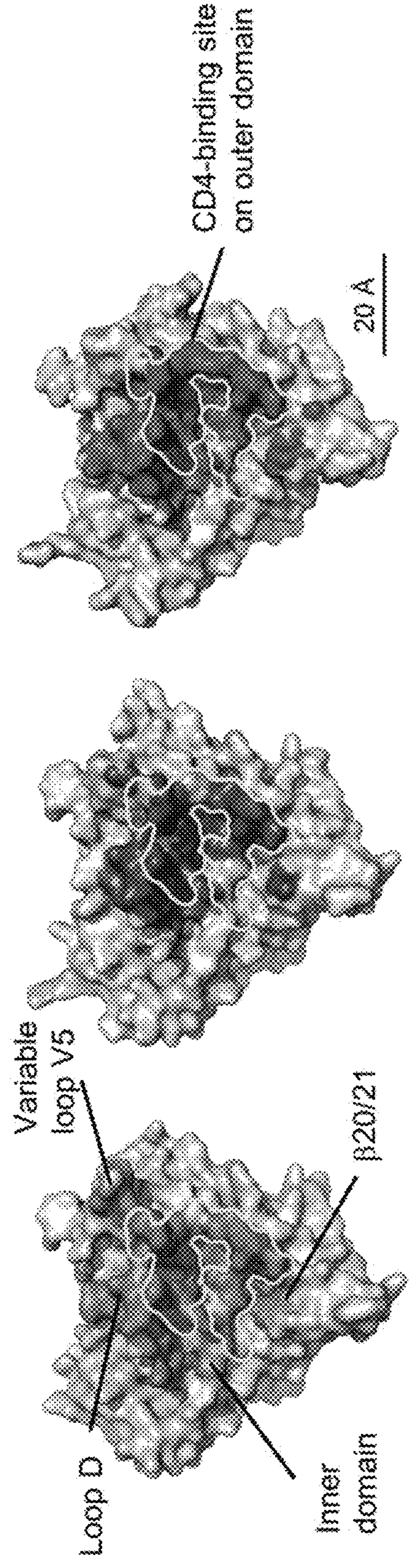

To gain insight into the structural consequences of maturation, we mapped the epitope of CH235 lineage members relative to the conformationally invariant CD4 supersite of vulnerability (Zhou et al., 2015). When we mapped the CH235 footprint on gp120, we observed portions of the CH235-binding surface on gp120 to be outside of the CD4 supersite of vulnerability (FIG. 42C, left). This surface was reduced in CH235.9 and CH235.12 structures, especially on variable loop V5. Recognition by the CH235.12 antibody concentrated almost entirely on the CD4 supersite of vulnerability, with little interactions with the inner domain or variable loop V5; there was, however, a large remaining interaction with the conserved loop D region (FIG. 42C, middle and right).

Figure 42D:
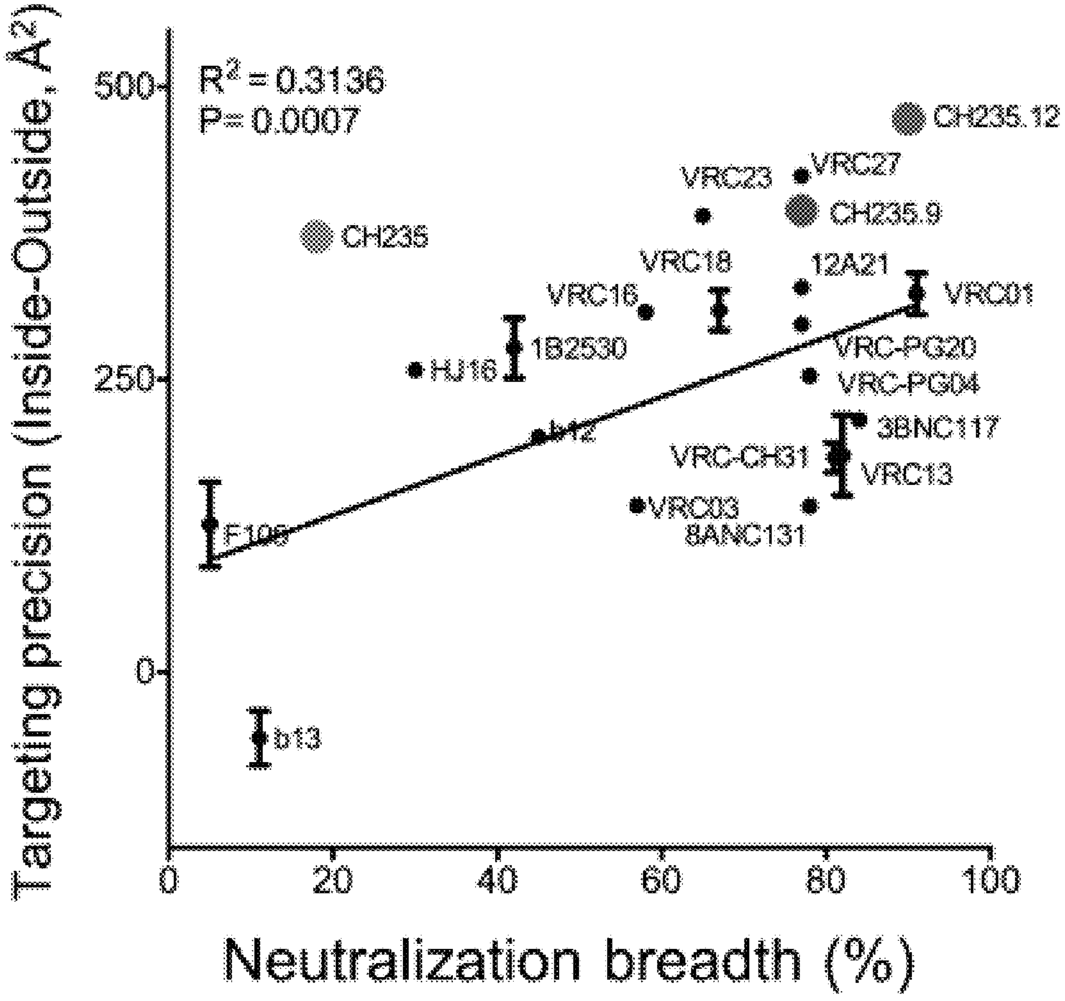
Figure 42E:
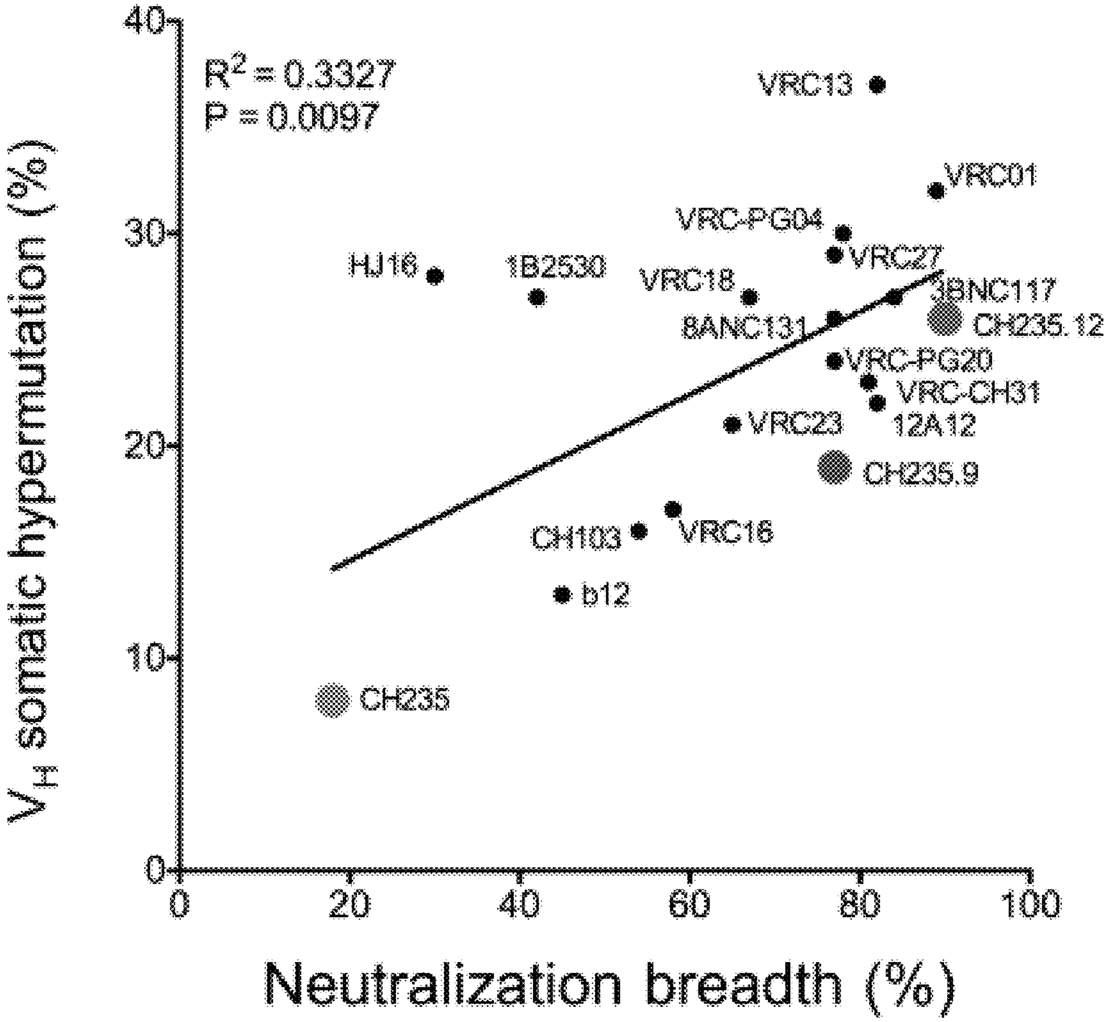

To quantify targeting precision, we computed the buried surface between antibodies and gp120 co-crystal complexes, for the region overlapping the CD4 supersite of vulnerability minus the region outside the vulnerable site. Overall targeting precision correlated with neutralization breadth (P=0.0007) (FIG. 42D). The CH235-lineage antibodies all showed good targeting precision. We also analyzed the correlation of SHM versus neutralization breadth (P=0.0097) (FIG. 42E): While the CH235 lineage generally trended towards lower SHM relative to neutralization breadth, all CD4bs bnAbs appeared to require a high degree of SHM, independent of whether the antibody derived from a specific $V_H$-gene or used a CDR H3-dominated mode of recognition.

Overall, the results suggest that maturation requires a high degree of SHM to focus recognition onto the CD4 supersite of vulnerability and that this high degree of SHM is a general requirement of all CD4bs bnAb lineages, even those that begin with highly favorable orientations such as CH235.

Conformity of Sequence Evolution of CH235 Lineage.

The mutation levels of CH235-lineage antibodies isolated 41 wks post infection from memory B cell cultures was markedly lower (range 7-11%;) than that of all previously reported $V_H$1-46 and $V_H$1-2 CD4bs bnAbs (>25%) (Scheid et al., 2011; Sui et al., 2010; Wu et al., 2010; Zhou et al., 2015) (FIG. 53). The mutation levels of CH235-lineage antibodies isolated up to 264 wks post infection increased to 20%, but were still lower than those of most other bnAbs until 323 wks post infection (CH235.12: 26% mutations) (FIG. 43A).

Figure 50A:
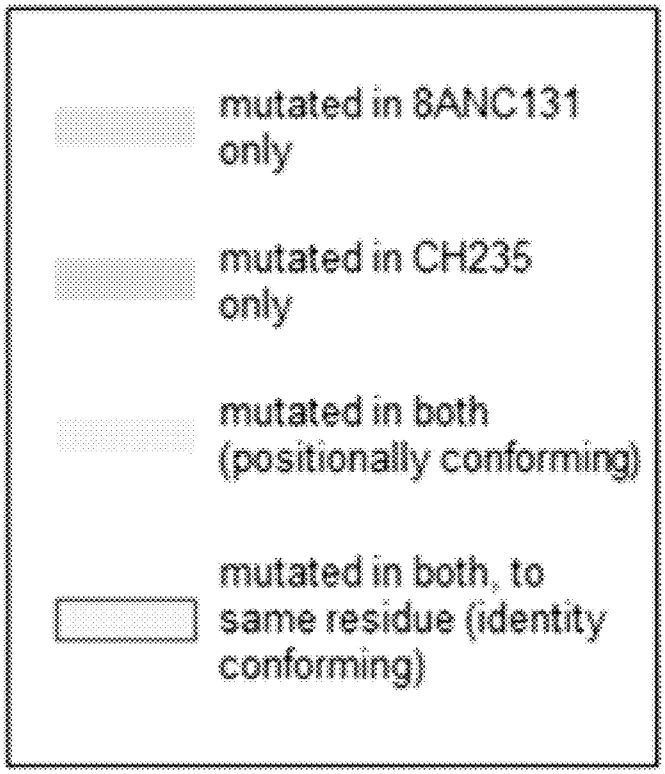

To quantify the conformity of CH235-lineage antibodies to the two $V_H$1-46-derived bnAbs (1B2530 from donor RU1 and 8ANC131 from donor RU8) (Scheid et al., 2011; Zhou et al., 2015), we analyzed the similarity of shared mutation positions (positional conformity) and shared identical mutations (identity conformity) of the $V_H$ genes (FIG. 43B, FIG. 50A). As a comparison, we also calculated the positional conformity and identity conformity of non-HIV-1 targeting antibodies isolated from 3 HIV-1 negative donors relative to template antibodies 1B2530 and 8ANC131. Positional conformity in SHM was spread over a large range (50-90%), and there did not seem to be much discrimination between $V_H$1-46 in antibodies that effectively neutralized HIV-1 and those that did not (FIG. 43B, top panels). Identity conformity in SHM was also spread over a large range (0-75%) (FIG. 43B, bottom panels), and while little discrimination was observed between $V_H$1-46 in antibodies that effectively neutralized HIV-1 and those that did not for antibody 8ANC131, there was discrimination among CD4bs antibodies when 1B2530 was used as a reference (FIG. 43B, bottom left panel). The differences in CH235-lineage identify conformity to 1B2530 or to 8ANC131 may reflect the greater similarity of the recognition orientation of CH235-lineage members with 1B2530 (FIG. 49C) and suggested that slight differences in recognition orientation can substantially alter factors associated with identity conformity.

Figure 50B:
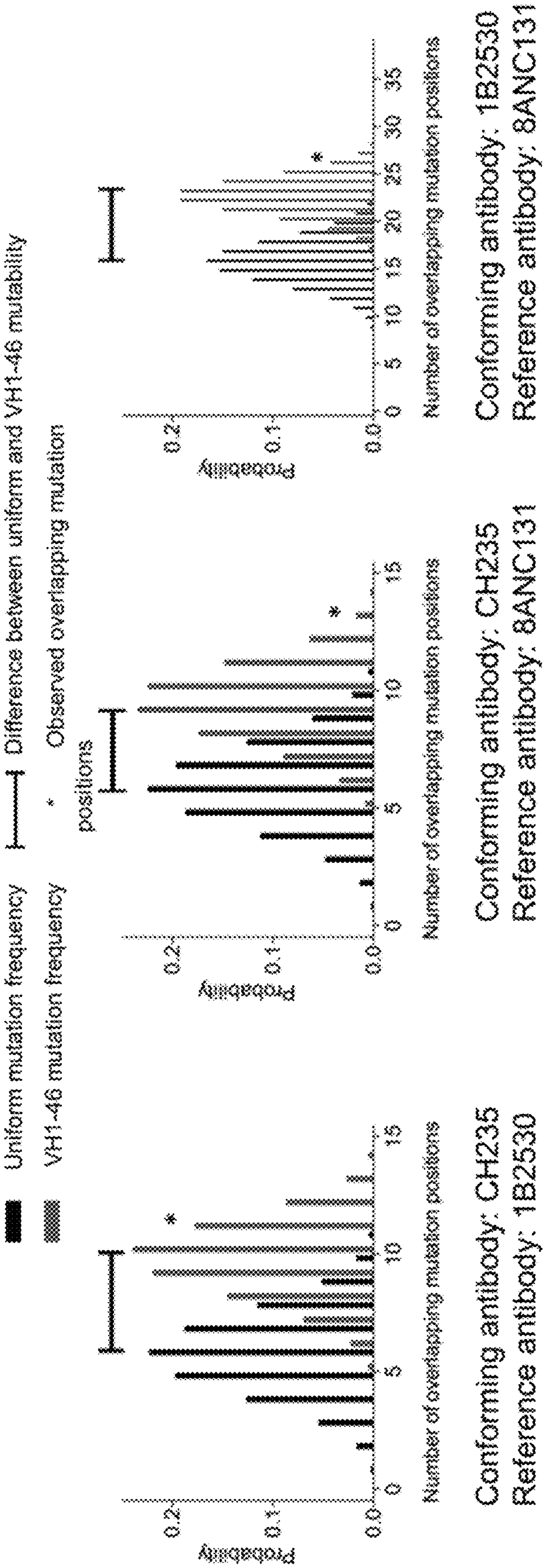
Figure 50C:
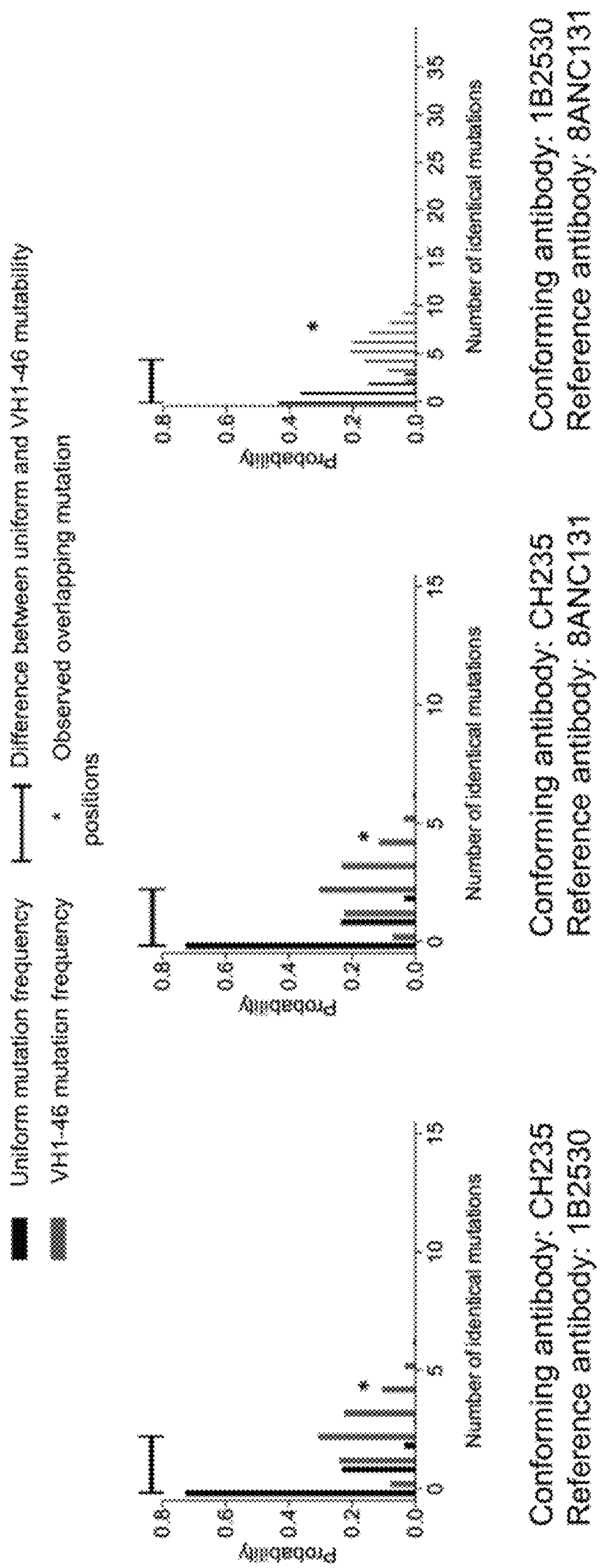

Overall, these results indicated SHM in response to HIV-1 infection to proceed in a manner that depended less on functional selection and more on intrinsic properties of the $V_H$1-46-gene, especially related to the position of residues that undergo SHM. To investigate further the contribution of the $V_H$1-46 gene, we analyzed SHM observed in $V_H$1-46 gene transcripts from three uninfected individuals (FIG. 43C, top); notably, all 11 positions mutated in CH235, 1B2530 and 8ANC131 were also mutated among non-HIV-1 neutralizing antibodies with high frequency (≥20%). Moreover, the residue substitutions in CH235 were frequently found in the top three most commonly observed substitutions for that position in the $V_H$1-46 gene. To quantify the impact of gene mutability, we compared the difference in probability distributions of positional and identity conformity for sequences simulated with and without taking into account the intrinsic $V_H$1-46 gene mutability. The simulations showed that both positional and identity conformity shifted to a higher level of similarity when considering gene mutability (FIGS. 50B and 50C). Notably, a substantial shift in probability was observed for the positional conformity of CH235 (FIG. 50B, FIG. 56A). Similar shifts in identity conformity were also observed for CH235 (FIG. 50C, FIG. 56B). Thus, the intrinsic susceptibility at specific sites of the $V_H$1-46 germline gene to mutation as well as to the frequency of specific mutations that existed at each of these sites appeared to be a dominant factor in the SHM alteration of the CH235 lineage. These results are in line with our previous finding that selection and mutability synergized during affinity maturation of an influenza HA-reactive clone from a non-HIV-1 infected person to hemagglutinin (HA) (Kepler et al., 2014): hence, the dominant role of intrinsic susceptibility at specific sites may be a more general biological phenomenon in dictating the course of SHM.

Because $V_H$1-2 is genetically the most closely related germline gene to $V_H$1-46, we also examined the mutability of the $V_H$1-2 gene (FIG. 43C, bottom). Consistent with $V_H$1-46 antibodies, the mutated positions among $V_H$1-2 derived bnAbs also showed high frequency of mutation among non-HIV-1 targeting $V_H$1-2 antibodies, suggesting that gene mutability contributes to $V_H$1-2 derived HIV-1 antibody evolution. Notably, the average mutability of the $V_H$1-2 gene at positions where the CH235 antibody showed SHM was generally high: 9 of 15 positions mutated in CH235 antibody were also mutated in more than 15% of $V_H$1-2-derived NGS reads. In 10 of these 15 positions, the mature $V_H$1-2-derived bnAbs (VRC01, VRC-CH31 and VRC-PG04) also showed changes. When we analyzed mutability of other $V_H$ genes used by CD4bs bnAbs ($V_H$1-69, $V_H$3-23, $V_H$3-30, and $V_H$4-59) (Zhou et al., 2015) (FIG. 50D), we observed gene mutability patterns different from that of $V_H$1-46 while, in contrast, the mutability patterns of $V_H$1-2 and $V_H$1-46 were more similar (FIG. 56C). Despite the similarity between $V_H$1-2 and $V_H$1-46, we did observe that antibody sequences from CD4bs bnAbs of each gene segregated phylogenetically (FIG. 50E), indicating differences in maturation pathway between bnAbs evolving from these two germline genes.

These data suggested that for both $V_H$1-2 and $V_H$1-46 germline genes-derived bnAbs, somatic mutations that lead to neutralization breadth appeared to be primarily determined by the intrinsic mutability of $V_H$1-46 and $V_H$1-2 germline genes. The differences in the intrinsic mutabilities of these $V_H$ genes may contribute to the high occurrence of CD4bs bnAbs that originate from either $V_H$1-2 or $V_H$1-46 (Zhou et al., 2015).

Interaction Between CH235 and CH103 bnAb Lineages.

While gene mutability plays a role in determining the position where SHM occurs, binding between antibody and HIV-1 Env likely also plays a role in selecting or fixing a mutation. A hallmark of cooperating B cell lineages is that they interact at the same site as the bnAb lineage that is being driven (Gao et al., 2014).

To determine a mechanism whereby the initial interaction of the early CH235 and CH103 lineage members bind to the same or similar epitope and result in CH235 selection of escape mutants that stimulated the CH103 bnAb lineage (Gao et al., 2014), we evaluated cross-competition between early CH235 lineage antibodies and the CH103 lineage antibody CH106 in ELISA, as an example of early CH103 lineage development, and measured their association rate constant with surface plasmon resonance (SPR). Since both the CH235 and CH103 lineages bound to the loop D gp120 region, we asked if the early CH235 lineage antibodies could block the binding of the CH103 lineage mature antibody CH106, or block the binding of soluble (s)CD4 to CH505 TF gp120 Env. CH241 was the only antibody in the CH235 lineage that strongly blocked CH106 bnAb and sCD4 binding to CH505 gp120 ($IC_{50}$=2.6 and 1.5 μg/ml, respectively) (FIG. 57A).

To confirm early dominance of the binding of CH103 lineage compared to the CH235 lineage to CH505 TF Env, we reversed the blocking assay and asked if bnAb CH106 could block the binding of biotinylated CH235, CH236, CH239, CH240 or CH241. CH106 strongly blocked the binding of all the CH235 mature antibodies with IC50s ranging from 2.3 μg/ml (for CH240) to 14.3 μg/ml (for CH241) (FIG. 57B). These data suggested that the earliest maturation intermediates of the CH235 lineage antibodies could not outcompete CH106 bnAb for binding to CH505 TF gp120 Env.

Affinity maturation in germinal centers is subjected to kinetic selection and involves improvement in dissociation rate constant ($K_d$) that is often driven by an improvement in the kinetic association rate ($k_a$), which is a key variable in conferring a binding advantage for the cognate epitope to an antibody over other competing antibodies (Foote and Milstein, 1991; Kepler et al., 2014). We measured the $k_a$ and dissociation kinetic rate ($k_d$) of the CH505 TF gp120 Env binding by CH235 and CH103 with SPR to identify differences that might explain the relative inability of the CH235 lineage to block the binding of the CH103 lineage bnAbs to autologous CH505 TF Env and found that the two lineages followed two distinct trajectories and modalities to increase their overall affinity.

The UCA of the CH103 lineage bound to CH505 TF Env with a $K_d$ of 227 nM which increased one order of magnitude throughout affinity maturation (FIG. 44A). The CH103 UCA displayed a fast association rate ($k_a$=37×$10^3$ $M^{-1}s^{-1}$) which was maintained across the intermediate and mature mAbs ($k_a$=11.9-37.3×$10^3$ $M^{-1}s^{-1}$), suggesting that maintaining the fast association rate was important for survival and maturation of the CH103 lineage (FIG. 44B). In contrast, the CH235 lineage mAb $K_d$ increased four orders of magnitude during affinity maturation (from 30.6 mM of IA4—the earliest intermediate mAb in the CH235 lineage for which kinetic rates could be measured—to 0.7 nM of CH241) (FIG. 44C). Such increase was predominantly facilitated by slower dissociation rates ($k_d$) observed in later intermediates and mature mAbs, which decreased from 88.1×$10^{-3}$ $s^{-1}$ of IA4 to 0.33×$10^{-3}$ $s^{-1}$ of CH241 (FIG. 44D). Conversely, CH235 lineage mAbs bound to CH505 TF gp120 Env with $k_a$ that started off an order of magnitude slower than CH103 UCA and its earlier intermediates (IA4 $k_a$=2.9×$10^3$ $M^{-1}s^{-1}$) and only modestly improved—primarily between IA1 and CH235 mAbs—with the majority of the early CH235 mAbs having slower $k_a$ than CH103 mAbs (FIG. 44D).

Thus, the relative inability of wk 41 CH235 lineage antibodies to block early mature CH103 lineage mAbs could be explained by the observed differences in their association rates, and these data provide an explanation of how the CH235 antibody lineage exerted its cooperating function in driving autologous virus toward better neutralization by the CH103 antibody lineage without impeding concurrent development of the CH103 antibody lineage itself.

Late CH235 Lineage Broadly Neutralizing Antibodies Neutralize Autologous Loop D Escape Viruses Selected by Early CH235 Lineage Members.

We have previously demonstrated that the CH235 lineage selected escape viruses with mutations in the loop D region of gp120 Env that rendered loop D mutant viruses more sensitive to the CH103 bnAb lineage and that autologous virus escaped from early CH235 lineage antibodies by wk 30 after infection (Gao et al., 2014). We have now isolated autologous viruses through wk 323 and determined the neutralization capacity of the late CH235 lineage bnAbs. Viruses partially sensitive to the later members of the CH235 lineage (particularly bnAbs CH235.9 and CH235.12) were found as late as wk 176 (FIG. 45A, FIG. 58). These viruses still contained the loop D mutations that were selected by virus escape from early antibody members of the CH235 lineage (Gao et al., 2014). Hence, we tested the ability of the late CH235 lineage bnAbs to neutralize the panel of CH505 TF loop D mutants (Gao et al., 2014). Remarkably, CH235.9, CH235.12 and CH235.13 bnAbs acquired the ability to neutralize all loop D mutants that were resistant to the early members of the CH235 lineage (FIG. 45B and FIG. 59). In particular, CH235.9, CH235.12 and CH235.13 neutralized CH505 TF gp120 M8, M20 and M21 (not neutralized by early lineage member CH236), which differed from CH505 TF gp120 M6 and M10 (neutralized by CH236) by a single mutation at position 280 (N280S for M8 and M20, and N280T for M21) (FIG. 45B).

In the gp120-complexed structure, the side chains of N280 forms three hydrogen bonds with two residues in the CDR L3 and these hydrogen bonds are predicted to be disrupted by the N280S and N280T mutations (FIG. 51A). Since the CH235.9 antibody had the $V_L$ of CH236, the direct implication was that mutations in the heavy chain were responsible for the ability of CH235.9 to neutralize loop D mutant viruses. Interestingly, CH235.7, which did not neutralize autologous viruses beyond wk 53, also had the $V_L$ of CH236 but, in contrast to CH235.9, failed to neutralize CH236-resistant loop D mutants M7, M8, M9, M20 and M21.

Therefore, we reverted the 5 amino acids (aa) in CH235.9 $V_H$ at gp120 contact positions that were different from those present in CH236 $V_H$ but not shared with CH235.7 $V_H$: N30T and D31T in CDR H1, G62Q and G65Q in FR H3 and A103E in CDR H3 (FIG. 51B). Five of the six CH235.9 mutants retained the ability to potently neutralize all the CH505 TF loop D mutant viruses. In contrast, the N30T mutation in CDR H1 reverted CH235.9 to the CH236 phenotype (CH236 has a threonine in position 30): M21 neutralization was abrogated, M20, M7 and M9 were near completely abrogated (CH235.9 N30T $IC_{50}$>44 μg/ml) and M8 $IC_{50}$ increased 37-fold (CH235.9 $IC_{50}$=0.66 μg/ml vs CH235.9 N30T $IC_{50}$=24.31 μg/ml) (FIG. 59).

Thus, acquisition of extraordinary breadth in the CH235 bnAb lineage was associated with accumulation of somatic mutations in CDR H1 that enabled late CH235 lineage antibodies to neutralize autologous loop D mutant viruses that were escape mutants from early CH235 antibodies. CH235.9 bnAb residue N30 contacts R429 in the P20-P21 loop of the C4 region of gp120 Env, which is on the opposite face of the CD4bs from loop D (FIG. 45C). In addition, CH505 TF has a glutamic acid in position 429 that is in close enough proximity to N30 to form a hydrogen bond.

These findings indicate a mechanism for acquiring the ability to neutralize loop D mutants via a compensatory mutation in the CH235 $V_HDJ_H$ which strengthens the binding to the gp120 C4 region by introducing hydrogen bonds that correct the loss of neutralization due to disruption of the hydrogen bonds between loop D and the CH235 mAb light chain.

CH235 and CH103 Lineage Antibody Binding to CH505 gp120 Env.

We tested the CH235 lineage antibodies for binding to 113 recombinant CH505 gp120 Env isolated from time of transmission to wk 160 post-transmission, including CH505 TF loop D mutant Envs (FIG. 46A and FIG. 60). Of note, CH235.9 and CH235.12 bound to 4/22 and 8/22 Envs isolated from wk 136 and 160 post-transmission, respectively, including Envs from viruses that were also neutralized. We have previously reported Env binding to the initial members of the CH103 lineage (Hraber et al., 2015), and have now performed the same Env binding analysis of the CH103 lineage with 10 additional matured bnAb members of the CH103 lineage (FIG. 46A and FIG. 60). We have used these data to select CH505 gp120 Env quasi-species that bound to mature and precursor bnAbs of both lineages, defining a series of CH505 Env immunogens now optimized and predicted to induce both bnAb lineages (FIG. 52A).

We had previously reported that CH235 UCA weakly reacted with CH505 TF gp120 at ~10 M as determined by SPR (Gao et al., 2014). Here we show stronger binding of the CH235 UCA to 8/113 autologous CH505 gp120 Envs measured in ELISA (FIG. 46A and FIG. 60). Moreover, in a panel of 15 heterologous Envs from multiple clades, CH235 UCA bound to 3/15 Envs and the introduction of only 3 mutations (W47L, G54W and S56R), which were selected based on the increase in surface area of interaction (G54W and S56R) or the reduction in clash score (W47L), increased this recognition (to 5/15 Envs), of which the dominant effect appeared to be reduction in clash (FIG. 46B and FIG. 52B).

Autoreactivity in the CH235 B Cell Lineage.

Figure 47B:
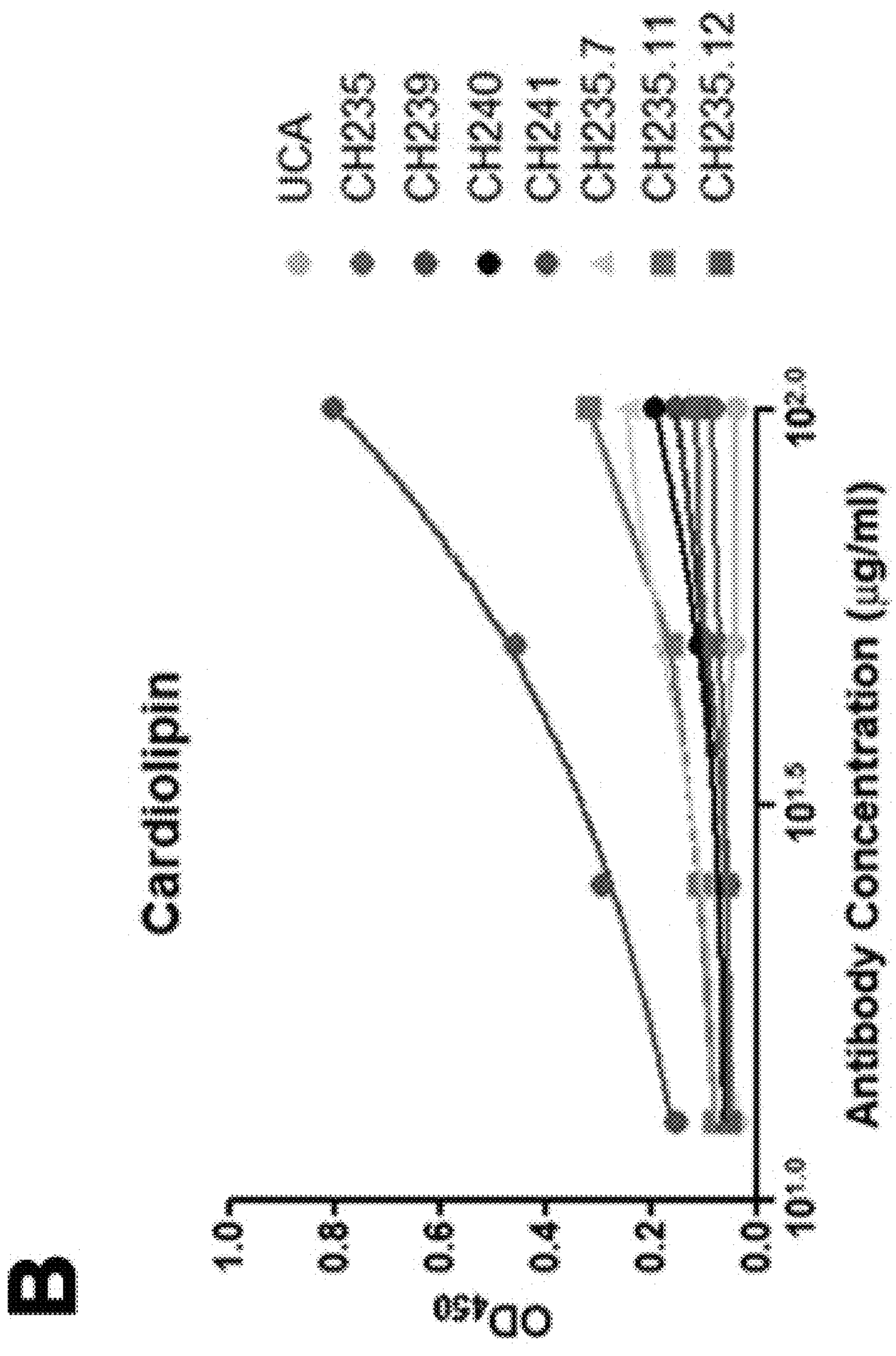
Figure 47C:
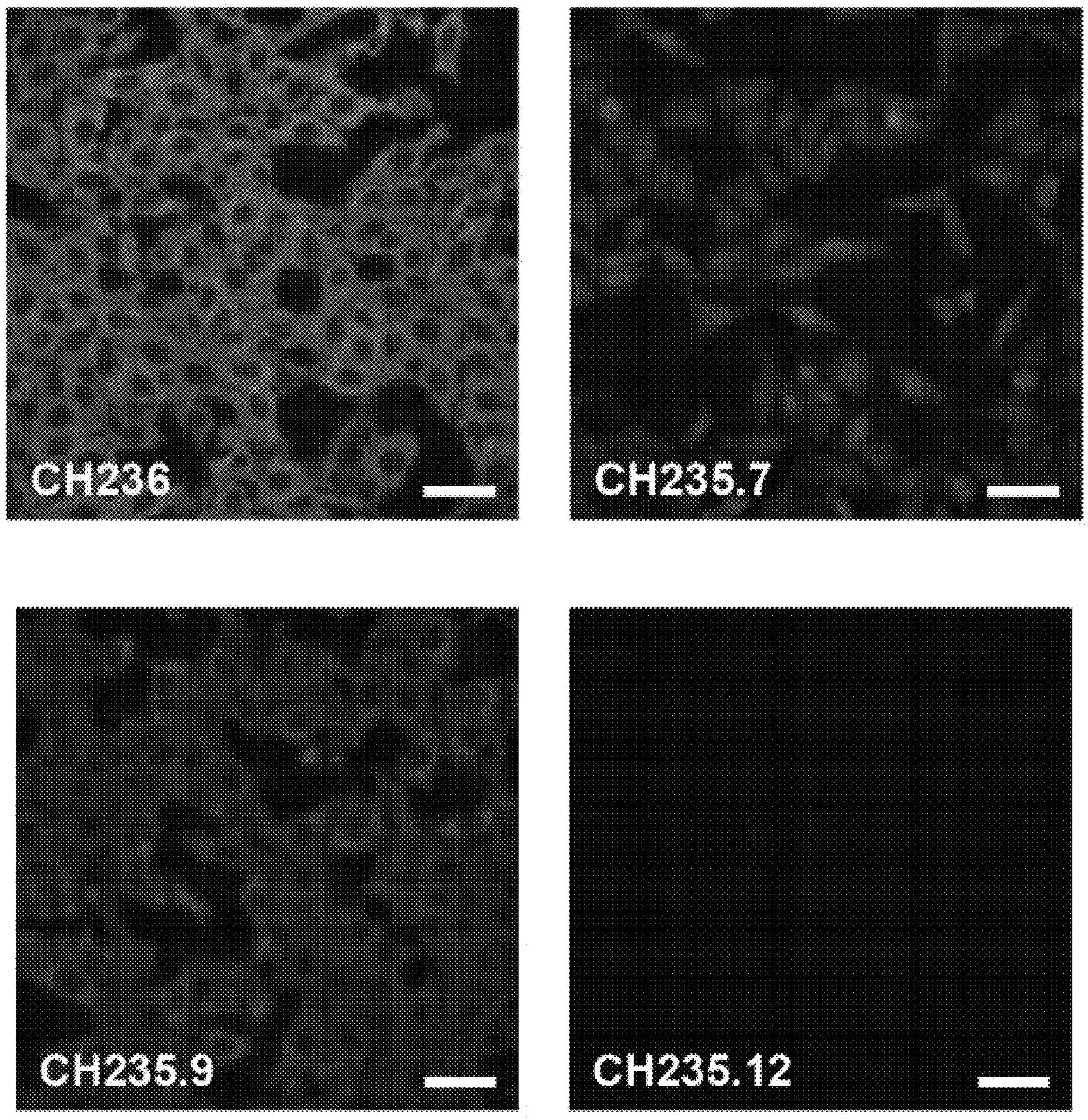
Figure 47D:
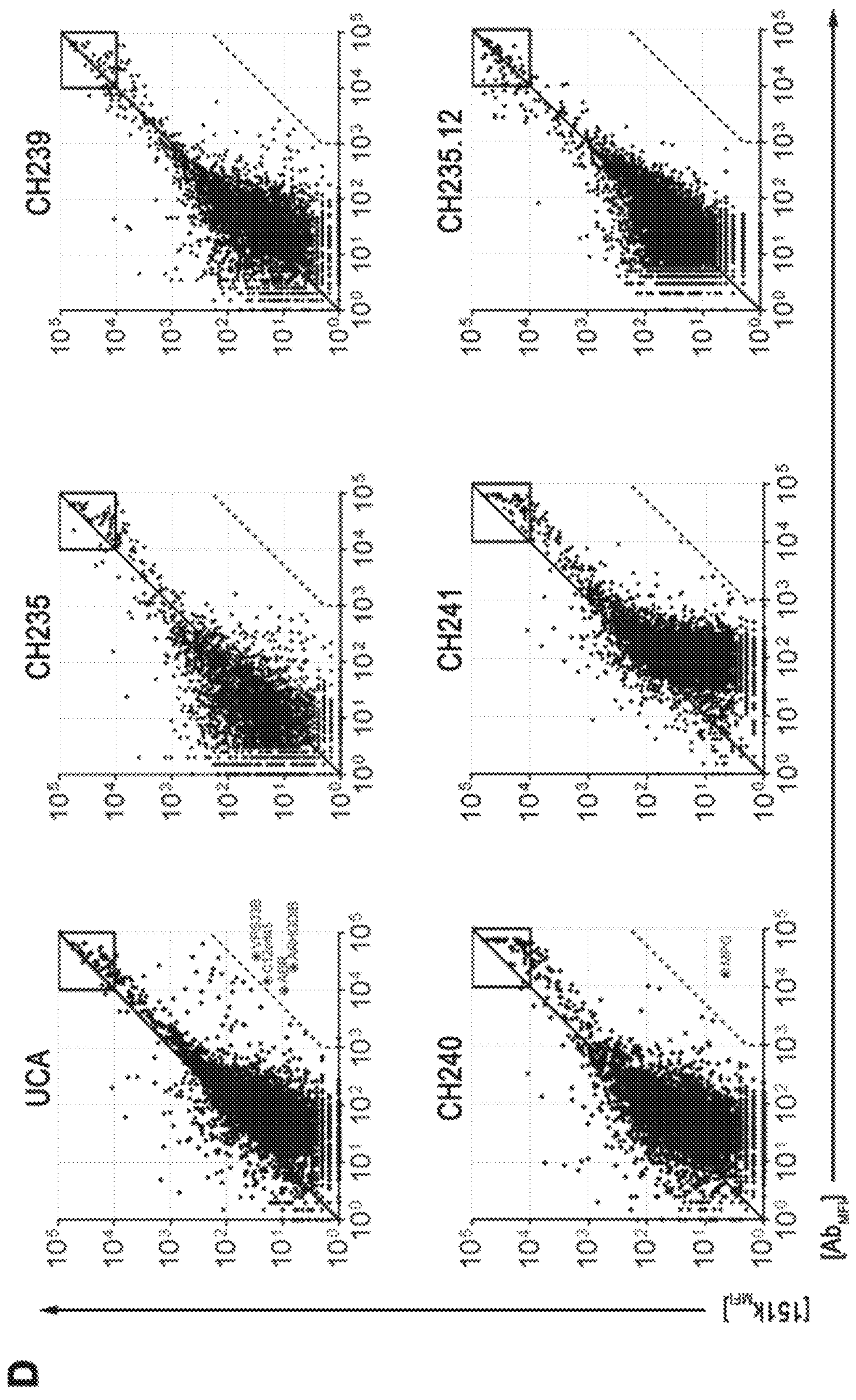

Development of auto- and polyreactivity during antibody maturation toward neutralization breadth is a critical aspect that may limit the ability of generating bnAbs during natural infection and upon vaccination (Bonsignori et al., 2014; Haynes et al., 2005; Haynes et al., 2012; Haynes and Verkoczy, 2014; Liu et al., 2015; Verkoczy et al., 2013; Verkoczy et al., 2010; Verkoczy et al., 2011). We had previously reported that in HIV-1-infected individual CH505, the CD4bs CH103 bnAb lineage was polyreactive and, similar to VRC01-class bnAbs, bound to human ubiquitin ligase E3A (UBE3A) with avidity correlated with neutralization (Liao et al., 2013; Liu et al., 2015). In addition, most of the mutations introduced in VRC07—a somatic variant of VRC01—that enhanced neutralizing activity also resulted in increased autoreactivity (Rudicell et al., 2014). Since CH235.12 is a potent and extremely broad CD4-mimic CD4bs bnAb, we compared the auto- and polyreactivity profile of CH235.12 with other members of the CH235 lineage. Most CH235 lineage antibodies displayed reactivity against DNA and sporadic reactivity with Scl70 (CH235.7) (FIG. 47A). CH241 bound to cardiolipin (FIG. 47B). In Hep-2 IF staining CH236, CH235.7 and CH235.9 were all cytoplasmic positive (FIG. 47C). Conversely, CH235.12, despite being highly mutated and broadly neutralizing, did not display autoreactivity in any of these assays (FIG. 47A-C) Of particular note, CH235 lineage antibodies, including CH235.12, did not react with UBE3A (FIG. 47D).

These data identify CH235.12 as an antibody that has developed neutralization breadth without being itself auto- and polyreactive, while less mutated precursor antibodies (CH235 is in the same clade of CH235.12) did develop autoreactivity. We conclude that in vivo decoupling of neutralization breadth of CD4 mimic CD4bs bnAbs from auto- and polyreactivity can occur, even for bnAb lineages that have developed autoreactivity during the course of their maturation and, therefore, inducing such bnAbs from such lineages through vaccination, though difficult, is an achievable goal.

Discussion

Here we have traced the ontogeny of the CH235 $V_H$1-46 8ANC131 class of CD4bs bnAbs from acute infection to chronic infection and defined both the structural and functional pathways of bnAb lineage induction. That the CH235 bnAb lineage that selected virus escape mutants that drove the CH103 CD4bs CDR H3-dependent bnAb lineage is itself an 8ANC131-class bnAb lineage and co-evolved with the CH103 bnAb is a remarkable demonstration of a bnAb-to virus-to bnAb interaction in the same HIV-1 infected individual. In addition, the similarity of $V_H$1-46 8ANC131-like and $V_H$1-2 VRC01 family CD4 supersite bnAbs demonstrates dramatic convergence of antibody structures to recognize the CD4 supersite. The CH235 lineage required over 20% SHM in heavy chain variable domain to achieve 90% breadth. Fortunately, a substantial portion of the $V_H$-gene SHM was guided by the intrinsic mutability of the $V_H$1-46 germline gene. Moreover, the CH235 lineage Ab that became broadly neutralizing acquired the ability to neutralize loop D mutants selected by early Ab lineage members (Gao et al., 2014) with a mechanism involving a compensatory mutation (T30N) in CDR H1, which allowed the formation of H-bonds with the HIV-1 gp120 C4 region, thus correcting the original loss of binding.

The driving forces of the CH235 lineage were the natural transmitted/founder and M5 Envs. In addition, despite near-complete autologous virus escape from CH235 lineage antibodies by wk 100, viruses arose later during the course of infection, which were sensitive to the more mature CH235 bnAb members and likely contributed to antigen drive. It is interesting to note that many of these late viruses were less sensitive to CH103 CDR H3 binder bnAbs prompting the hypothesis that the CH103 lineage may have the capacity for cooperation with the CH235 lineage after 5-6 years of co-development. Finally, the CH235.12 antibody that evolved late in CH235 development is an extraordinary broad and potent non-autoreactive antibody and is a candidate for preventive and therapeutic uses.

In summary, the acquisition of neutralization breadth in the CH235 VRC01-like $V_H$1-46 CD4 mimic bnAb occurred with the sequence of transmitted/founder and early mutant-initiated antigen drive, selection of Env loop D mutants that cooperated with the CH103 bnAb lineage to drive it to bnAb breadth, followed by acquisition of the ability of the CH235 lineage itself to neutralize autologous loop D mutants coincident with potent neutralization of a broad array of heterologous HIV-1 isolates. Mapping these events points to a strategy for the simultaneous induction of both CDR H3 and VRC01-class CD4bs bnAbs, whereby sequential immunizations with transmitted founder Env followed by loop D mutant Envs comprise a rational immunization strategy.

Experimental Procedures

Donor and sample information. Donor and sample information was previously reported (Liao et al., 2013) and is summarized in Supplemental Experimental Procedures. Memory B cell cultures were performed on PBMCs collected at 264 and 323 wks post-transmission. All work related to human subjects was in compliance with Institutional Review Board protocols approved by the Duke University Health System Institutional Review Board.

Preparation of libraries for 454 DNA pyrosequencing. 454 DNA pyrosequencing was performed on genomic DNA template isolated with Qiagen kits from PBMCs collected at 6, 7, 8, 9, 14, 20, 22, 30, 41, 53, 66, 92, 100, 144 and 152 wks post-transmission as described in (Boyd et al., 2009) and in Supplemental Experimental Procedures. Only unique V-heavy rearrangements were included in the analysis to generate the phylogeny; in the case of duplicated sequences, the earliest occurrence was included in the analysis.

Phylogenetic analysis. For clonal phylogenetics, the UCA was inferred using Cloanalyst (Kepler, 2013), which simultaneously estimates the UCA and the phylogenetic tree relating the observed sequences to each other and to the UCA. Internally, Cloanalyst uses dnaml from the PHYLIP suite of phylogenetic software (Felsenstein, 2005). The CH235 antibody lineage clonogram was displayed using the ete2 Python package.

Isolation of CH235 Lineage Antibodies from Donor CH505. Fluorescence-activated cell sorting of antigen-specific $IgG^+$ B cells from PBMC and the amplification and cloning of immunoglobulin genes were performed as described in (Bonsignori et al., 2011). CH505.TF gp120 Env-positive memory B cells were cultured as described in Supplemental Experimental Procedures.

Neutralization assays. Neutralization of donor CH235 mAbs were measured using single-round-of-infection HIV-1 Env pseudoviruses and TZM-bl target cells as described in Supplemental Experimental Procedures.

Neutralization signature. Antibody neutralization signatures were computed and compared as described in Supplemental Experimental Procedures.

Monoclonal Antibody and Antigen-Binding Fragment (Fab) Production. Ig genes of mAbs were amplified from RNA and expression plasmids for heavy and kappa chains were constructed. Expression and purification of recombinant IgG mAbs and preparation of Fab fragments are described in Supplemental Experimental Procedures.

Crystallization, X-Ray Data Collection, Structure Determination, and Refinement of Donor CH235 Antibodies in Complex with HIV-1 gp120. Purification, crystallization of antibody-gp120 complexes, data collection, structure solution, refinement and analysis are described in Supplemental Experimental Procedures. Diffraction data were integrated and scaled with the HKL2000 suite (Otwinowski and Minor, 1997).

Electron microscopy data collection and processing. BG505 SOSIP.664 and B41 SOSIP.664 gp140 trimers and donor CH235-derived Fab complex negative-stain electron microscopy images, analysis and visualization are described in the Supplemental Experimental Procedures.

Focused maturation and conformity analysis. Focused maturation and mAb conformity analysis are described in the Supplemental Experimental Procedures.

Surface Plasmon Resonance Affinity and Kinetics Measurements. MAb binding to autologous CH505 gp140 was measured using a BIAcore 3000 or BIAcore T200 instrument (GE Healthcare) as described in (Alam et al., 2007; Alam et al., 2009; Liao et al., 2013) and in Supplemental Experimental Procedures.

Direct-Binding ELISA. Direct-binding ELISAs were performed as described in Supplemental Experimental Procedures.

MAb CH235.9 Amino Acid Reversion. Site-directed mutagenesis of the CH235.9 mAb genes was performed using the Quikchange lightning multi-site-directed mutagenesis kit (Agilent) following manufacturer's protocol. Primers are listed in Supplemental Experimental Procedures.

Structural Modeling. Loop D mutations were structurally modeled using PyMOL with sidechains placed in the most frequently observed rotamer that did not result in steric clashing with neighboring residues. Hydrogen bonds were calculated using HBPLUS software (McDonald and Thornton, 1994).

Recombinant HIV-1 Proteins. HIV-1 genes of autologous CH505 Env were determined from samples collected from 4 to 323 wks post-infection by single genome amplification (Keele et al., 2008) and produced as described in (Liao et al., 2013).

Protein Array. MAbs were screened for binding on protein microarrays (ProtoArray) (PAH0525101; Invitrogen) pre-coated with 9,400 human proteins in duplicate and screened following manufacturer's instructions and as described in (Liu et al., 2015; Yang et al., 2013).

HEp-2 cell staining. Indirect immunofluorescence binding of mAbs or plasma to HEp-2 cells (Zeuss Scientific) was performed as previously described (Bonsignori et al., 2014; Haynes et al., 2005).

Supplemental Experimental Procedures

Donor and Sample Information.

The CH505 donor, from which the CH103 and the CH235 antibody lineages were isolated, is an African male enrolled in the CHAVI001 acute HIV-1 infection cohort (Tomaras et al., 2008) and followed for over 6 years. During this time viral load ranged from 14,460 to 847,279 copies/ml (median=173,667 copies/ml), and CD4 counts ranged from 69 to 431 cells/$mm^3$ (median=294 cells/$mm^3$).

The time of infection was estimated by analyzing the sequence diversity in the first available sample using the Poisson Fitter tool (Giorgi et al., 2010) as described in (Liao et al., Nature 2013). Results were consistent with a single founder virus establishing the infection and with the earliest isolated virus sequences being taken 4 weeks post-transmission.

Flow Cytometry, Memory B Cell Cultures and mAb Isolation.

The HIV-1 CH505.TF gp120 envelope glycoprotein was produced and used in flow cytometry on PBMC collected from donor CH505 at week 264 and 323 post-transmission using a two-color technique as described (Gray et al., 2011).

CH505.TF gp120Env-positive memory B cells were cultured as described (Bonsignori et al., 2011) with the following modifications: non-irradiated MS40L cells were used as feeder cells at a concentration of 3,000 cells/well and were added to wells in which memory B cells were sorted in bulk; 50 ng/ml of recombinant human (rHu) IL-21 (200-21; Peprotech, Rocky Hill, N.J.) were added to the complete medium; memory B cells were distributed by limiting dilution at a calculated concentration of 2 cells/well; culture medium was refreshed every 5 days.

Cell culture supernatants were screened for neutralization of autologous CH505.TF virus using the tzm-bl neutralization assay (Bonsignori et al., 2011; Montefiori, 2005) and for binding to CH505.TF gp120 Env, CH505.TF Δ371I gp120 Env mutant, HIV-1 Env resurface core protein 3 (RSC3) and RSC3 Δ371I (Wu et al., 2010).

MAbs CH235.10 through CH235.13 were isolated from cultures that displayed differential binding of CH505.TF and CH505 TF Δ371I gp120 Env, did not bind to RSC3 (Gao et al., 2014) and neutralized 13 to 99% CH505.TF infectivity.

CH235 lineage antibody frequency over total memory B cells was calculated by dividing the number of CH235 lineage antibodies isolated at week 41 (n=5; Gao et al., 2014) for the number of memory B cells analyzed (n=27, 950). CH235 lineage antibody frequency over CH505.TF gp120 Env-specific memory B cells was calculated by dividing the number of CH235 lineage antibodies isolated at weeks 264 and 323 (n=4) for the number of CH505.Env gp120-specific memory B cells analyzed (n=794).

454 Pyrosequencing of CH235 Lineage Heavy Chains.

Antibody heavy chain gene rearrangements were PCR amplified from 6 independent 100 ng genomic DNA aliquots to generate 6 barcoded libraries per sample. Multiplexed primers complementary to the IGHV FR1 or FR2 framework regions, and an IGHJ-primer were modified from the BIOMED-2 consortium primers (Boyd et al., 2009; van Dongen et al., 2003). 10-nucleotide 'barcode' sequences in the primer sets encoded sample identity and replicate library identity. AmpliTaq Gold (Roche) enzyme was used for PCR following the manufacturer's instructions, with a thermocycler program: 94° C. 5 min; 35 cycles of (94° C. 30 sec, 60° C. 45 sec, 72° C. 90 sec); and final extension at 72° C. for 10 min. Following quantitation, PCR products from each replicate library were pooled in equimolar amounts, then the pooled library was run on a 1.5% agarose gel and gel extracted (Qiagen). High-throughput sequencing was performed on the 454 (Roche) platform using Titanium chemistry.

Antibody Production.

Immunoglobulin genes of mAbs CH235.10 through CH235.13 were amplified from RNA from isolated cells, expression cassettes made, and mAbs expressed as described (Gao et al. 2014). The $V_H$ genes of mAbs CH235.6 through CH235.9 were retrieved from sequences obtained through genomic DNA 454 sequencing, which were restored to full length and complemented with the $V_L$ of the phylogenetically closest isolated antibody in the CH235 lineage (i.e. CH241 for CH235.6 and CH235.8, and CH236 for CH235.7 and CH235.9). We have previously described the isolation of mAbs CH235, CH236, CH239, CH240 and CH241 and the inference of unmutated common ancestor (UCA) and intermediate antibodies IA1 through IA4 (Gao et al., 2014; Kepler, 2013).

Heavy chain plasmids were co-transfected with appropriate light chain plasmids at an equal ratio in Expi 293 cells using either 293Fectin or ExpiFectamine 293 transfection reagents (Thermo Fisher Scientific) according to the manufacturer's protocols. Cultures were supplemented with AbBooster antibody expression enhancer media (ABI Scientific) at 10% of the final culture volume 24 h after transfection. Cultures were then incubated at 33° C. for 5 more days, and supernatants were harvested and passed over a protein A affinity column. Following PBS wash and low pH elution, the pH of eluate was neutralized with 1MTris pH 8.5 and samples were dialyzed against PBS. Antibodies were then aliquoted and stored at −80° C. prior to use. Alternatively, for ExpiFectamine transfections we used the enhancer provided with the kit, transfected cultures were incubated at 37° C. 8% $CO_2$ for 2-6 days, harvested, concentrated and incubated overnight with Protein A beads at 4° C. on a rotating shaker before loading the bead mixture in columns for purification; following PBS/NaCl wash, eluate was neutralized with trizma hydrochloride and antibody concentration was determined by Nanodrop. Purified antibodies were tested in SDS-Page Coomassie and western blots, and stored at 4° C.

Direct-Binding ELISA.

Direct-binding ELISAs were performed as described previously (Bonsignori et al., 2011) with the following modifications: plates were blocked for 1 h at room temperature (RT) or overnight at 4° C. (both procedures were previously validated); primary purified antibodies were tested at a starting concentrations of 100 μg/ml, serially three-fold diluted and incubated for 1 h at RT; HRP-conjugated human IgG antibody was added at optimized concentration of 1:30,000 in assay diluent for 1 hour and developed using TMB substrate; plates were read at 450 nm in a SpectraMax 384 PLUS reader (Molecular Devices, Sunnyvale, Calif.); results are reported as logarithm area under the curve (LogAUC) unless otherwise noted.

For cell culture supernatant screening of RSC3 and RSC3 Δ371I HIV-1 Env core proteins reactivity, plates were coated with streptavidin (2 μg/ml); blocked plates were stored at −20° C. until used; 10 μl/well of biotinylated avi-tagged RSC3 and RSC3 Δ371I were added at 2 μg/ml for 30 minutes at RT and culture supernatants were added at 1:3 dilution in assay diluent; plates were developed for 10 min using SureBlue Reserve TMB (53-00-03; KPL, Gaithersburg, Md.) equilibrated at RT.

Competition ELISAs were performed using 10 μl of primary purified monoclonal antibody, starting at 100 μg/ml and diluted in a two-fold concentration, incubated for 1 h at RT; for CD4 binding site blocking assays, 10 μl of a saturating concentration soluble CD4 (Progenics Pharm Inc.) was added following antibody incubation step. Ten μl of biotinylated target Mab was added at the EC50 determined by a direct binding of biotinylated-Mab for one hour at RT. After background subtractions, percent inhibition was calculated as follows: 100-(sera triplicate mean/no inhibition control mean)*100.

Autoimmune purified antigens histones (whole), Jo-1, RNP/Sm, Scl-70, Sm, SSA (Ro), SSB (all from ImmunoVision) and centromere B (Prospec) were coated at optimal concentrations determined by lot-specific checkerboard with positive controls. All plasma antibody positive controls were purchased from ImmunoVision; lot-specific optimal ranges for standard curves were determined. All antibodies were tested using the same lots for each antigen and positive controls with the protocol described above. For DNA ELISA, plates were coated with 2 μg/ml poly-lysine (Sigma-Aldrich) for 2 h at RT, washed 3× with PBS and blocked with PBS/2%/BSA/0.05% Tween-20 for 2 h at RT. After 3× wash, DNA (LS002195, Worthington) in saline sodium citrate buffer was added for 1 h, washed and antibodies were incubated for 1 h. Secondary antibody was diluted in PBS/0.05% Tween-20. Plates were developed for 30 min. Human recombinant monoclonal antibody Ab008391 (courteously provided by David Easterhoff, Duke Human Vaccine Institute) was used as positive control. For all autoantigen ELISAs, palivizumab was used as negative control. For each antibody, LogAUC was calculated and data are presented semi-quantitatively: no binding=logAUC$_{Ab}$≤2× negative control logAUC$_{neg\ ctrl}$; to quantify antibody binding we divided (logAUC$_{pos\ ctrl}$−2× logAUC$_{neg\ ctrl}$) in tertiles and expressed test antibody binding as weak (+), intermediate (++) or strong (+++) if logAUC$_{Ab}$ was in the first, second or higher tertile, respectively.

Anti-cardiolipin ELISA was performed using the QUANTA Lite ACA IgG III kit (708625; INOVA Diagnostics) following manufacturer's protocol.

Assessment of Virus Neutralization Using a Large Panel and Calculation of Neutralization Dendrograms.

Neutralizing antibody assays in TZM-bl cells were performed as described previously (Montefiori, 2005). Neutralization breadth of CH235 UCA, CH235, CH235.9 and CH235.12 neutralization breadth was assessed using the 384-well plate declination of the assay using an updated panel of 199 geographically and genetically diverse Env-pseudoviruses representing the major circulating genetic subtypes and recombinant forms as described (Seaman et al., 2010; Wu et al., 2010). The data were calculated as a reduction in luminescence units compared with control wells, and reported as IC$_{50}$ in μg/ml (Montefiori, 2005).

Dendrograms were calculated using the neighbor-joining method, showing the protein sequence distance from the HIV-1 Env gp160 sequences of 190 HIV-1 primary isolates. The clades of HIV-1, including circulating recombinant forms (CRFs) are indicated.

Antibody Neutralization Fingerprinting Analysis.

Neutralization fingerprints were computed and compared for CH235, CH235.9 and CH235.12 from the CH235 lineage, other CD4-binding-site antibodies, and antibodies targeting other sites of vulnerability on HIV-1 Env. The fingerprints were computed over a common panel of 165 HIV-1 strains with neutralization data for all antibodies, and a hierarchical clustering procedure was applied for building the tree, as described in (Georgiev et al., 2013). Briefly, for each antibody, the neutralization data for the common set of 165 HIV-1 strains formed that antibody's neutralization fingerprint. The Spearman correlation coefficients for all pairs of antibody neutralization fingerprints were then computed, transforming the antibody-virus neutralization matrix into an antibody-antibody correlation matrix. This correlation matrix was then input into a hierarchical clustering procedure as a way to visualize the similarities between the neutralization fingerprints for the different antibodies. The distances in the resulting tree are thus a function of the differences between fingerprints.

VH1-46 and VH1-2 Antibody Dendrogram Calculation.

Phylogenic trees for multiple antibodies derived from VH1-46 and VH1-2 heavy chain variable genes were calculated using the neighbor-joining method. The sequences are aligned by Clustal Omega, calculated using ClustalW2. Dendrograms were drawn in Figtree.

Production and Purification of HIV-1 Env Protein Complexed to Antigen-Binding Fragments.

HIV-1 gp120 protein from clade AE 93TH057 and antibodies of CH235, CH235.9 and CH235.12 were produced and purified as described previously (Zhou et al., 2010). Fab fragments of antibodies were prepared by digesting purified IgG with Lys-C at 37° C. for 2-4 h. The digestion reaction was quenched by the addition of cOmplete protase inhibitors (Roche). The digested antibodies were passed over Protein A agarose to remove the Fc fragment. The Fab was further purified over a Superdex 200 gel filtration column and concentrated aliquots were stored at −80° C.

X-Ray Crystallography.

The gp120-antibody complexes were formed by mixing deglycosylated gp120 with the antibody Fab in a 1:1.5 molar ratio. The complexes were purified by size exclusion chromatography (Hiload 26/60 Superdex S200 prep grade; GE Healthcare) with buffer containing 0.35 M NaCl, 2.5 mM Tris (pH 7.0), and 0.02% $NaN_3$. Fractions with gp120-antibody complexes were concentrated to ~10 mg/ml and used for crystallization experiments. All gp120-Fab complexes were screened against 576 crystallization conditions using a Cartesian Honeybee crystallization robot. Initial crystals were grown by the vapor diffusion method in sitting drops at 20° C. by mixing 0.2 μl of protein complex with 0.2 μl of reservoir solution. Crystals were manually reproduced in hanging drops by mixing 0.50 μl protein complex solution with 0.5 μreservoir solution.

The 93TH057 core$_e$ gp120-CH235 complex was crystallized with a reservoir solution of 25% (w/v) of PEG2000, 0.2 M of $Li_2SO_4$, 0.1 M of Tris-HCl pH 8.5 and 5% (v/v) of isopropanol and was flash frozen in liquid nitrogen in mother liquor supplemented with 15% of 2R,3R-butanediol as a cryoprotectant. The 93TH057 core$_e$ gp120-CH235.9 complex was crystallized with a reservoir solution of 9% (w/v) of PEG8000, 19% (w/v) of PEG400, 0.1 M HEPES pH 7.5 and was flash frozen in mother liquor supplemented with an additional 15% PEG 400 as a cryoprotectant. The 93TH057 core$_e$ gp120-CH235.12 complex was crystallized with a reservoir solution of 10% PEG 8000, 20% PEG 400 and 100 mM HEPES, pH7.5 and was flash frozen in mother liquor supplemented with an additional 15-20% PEG 400 as a cryoprotectant.

Data for all crystals were collected at a wavelength of 1.00 Å at SER-CAT beamlines ID-22 and BM-22 (Advanced Photon Source, Argonne National Laboratory). All diffraction data were processed with the HKL2000 suite, structures were solved by molecular replacement using PHASER, and iterative model building and refinement were performed in COOT and PHENIX, respectively. For 93TH057core$_e$ complexes with CH235.9 and CH235.12, molecular replacement solutions were obtained using EAF31403.1-CH235 complex as a search model.

Throughout the refinement processes, a cross validation ($R_{free}$) test set consisting of 5% of the data was used and hydrogen atoms were included in the refinement model. Structure validations were performed periodically during the model building/refinement process with MolProbity. The 93TH057 core$_e$-CH235 structure was refined to a final $R_{free}$ value of 22.9% with 96% residues in the favored region of the Ramachandran plot, and 0.1% outliers. The 93TH057 core$_e$-CH235.9 structure was refined to a final $R_{free}$ value of 22% with 97.1% residues in the favored region of the Ramachandran plot, and 0% outliers. The 93TH057 core$_e$-CH235.12 structure was refined to a final $R_{free}$ value of 23% with 97.0% residues in the favored region of the Ramachandran plot, and 0.1% outliers. All figures containing representations of the protein crystal structures were made with PyMOL. Gp120 and antibody interactions were analyzed with the PISA server.

Surface Plasmon Resonance Affinity and Kinetics Measurements.

For kinetic measurement, each antibody was captured on an anti-human IgFc immobilized sensor surface (200-

500RU) and gp120 proteins at varying concentrations were injected to monitor association and dissociation phases. Buffer reference and non-specific binding to a control antibody (palivizumab) captured surface were used to derive specific binding signals. Kinetic rate constants and dissociation constant (Kd) were derived from global curve fitting analysis using a Langmuir 1:1 interaction model using the BIAevaluation 4.1 software (GE Healthcare).

Electron Microscopy Data Collection and Processing.

BG505 SOSIP.664 and B41 SOSIP.664 gp140 trimers were expressed in HEK293F cells and purified by 2G12-affinity and gel filtration chromatography as described elsewhere (Pugach et al., 2015; Sanders et al., 2013). Trimers were incubated with a 10 molar excess of Fab (CH235, CH235.9, or CH235.12) overnight at room temperature and the complexes were diluted to ~0.03 mg/mL prior to application onto a carbon-coated 400 Cu mesh grid that had been glow discharged at 20 mA for 30 s. The grids were stained with 2% (w/v) uranyl formate for 60 seconds. Samples were imaged using a FEI Tecnai T12 electron microscope operating at 120 keV, with an electron dose of ~25 $e^-/Å^2$ and a magnification of 52,000× that resulted in a pixel size of 2.05 Å at the specimen plane. Images were acquired with Leginon (Suloway et al., 2005) using a Tietz TemCam-F416 CMOS camera with a nominal defocus range of 1000-1500 nm. Automated particle picking, stack creation, and initial 2D classification was performed in the Appion software suite (Lander et al., 2009). Noise and junk particles were discarded and the remaining stack was subjected to 3D classification using Relion (Scheres, 2012) with an EM volume created from the x-ray structure of ligand-free BG505 SOSIP.664 (PDB: 4zmj) low pass filtered to 60 Å as the reference model. While both CH235.9 and CH235.12 bound to either B41 or BG505 at predominantly full stoichiometry (3 Fabs per trimer), CH235 bound to either trimer at sub-stoichiometric ratios (1 Fab per BG505 trimer and 2 Fabs per B41 trimer). The 3D classes representing the predominant stoichiometry for each complex were used as the initial models (low pass filtered to 40 Å) for further refinement using Relion, with C3 symmetry imposed for complexes with CH235.9 or CH235.12. The total number of particles used in refinement and final resolution of the map using a Fourier shell correlation of 0.5 are as follows: BG505 in complex with CH235—3,467 particles (~25 Å); B41 in complex with CH235—4,248 particles (~24 Å); BG505 in complex with CH235.9-2,567 particles (25 Å); B41 in complex with CH235.9-8,061 particles (19 Å); BG505 in complex with CH235.12-15,565 particles (17 Å); B41 in complex with CH235.12-17,023 particles (16 Å).

To create figures of each Fab in complex with a representative trimer, the 3D reconstructions for each complex were fit into an EM volume created from the x-ray structure of unliganded BG505 SOSIP.664 (PDB: 4ZMJ) low pass filtered to 30 Ain UCSF Chimera (Pettersen et al., 2004) and using the "segment map" option to isolate the density of the Fab components alone. Two-dimensional back projections of the final 3D models were generated using EMAN (Tang et al., 2007).

Epitope Visualization.

The HIV-1 gp120 epitopes targeted by donor CH235 antibodies were visualized using PyMOL (Schrodinger, 2010). In this graphic program, we used 5.5-Å distance for selection of epitope atom sets which were virtually identical to those defined by protein interface analysis program PISA.

Monoclonal Antibody CH235.9 Amino Acid Reversion.

Primers were designed with the online Agilent Quikchange primer designer tool (www.thermofisher.com) and were as follows:

```
CH235.9_N30T:
                                        (SEQ ID NO: 8)
CGTGGCGTCTGGATACAACTTCACCGACTACTATATAC;

CH235.9_D31T:
                                        (SEQ ID NO: 9)
CGTCTGGATACAACTTCAACACCTACTATATACACTGGGTGC;

CH235.9_G62Q:
                                        (SEQ ID NO: 10)
GGTCGCACAGATTACGCACAGGCGTTTGGGGA;

CH235.9_G65Q:
                                        (SEQ ID NO: 11)
GATTACGCAGGGGCGTTTCAGGACAGAGTGTCCA;

CH235.9_A103E:
                                        (SEQ ID NO: 12)
GTTAGAAATGTGGGAACGGAGGGCAGCTTGCTCCACTATG;

CH235.9_G62Q/G65Q:
                                        (SEQ ID NO: 13)
GGTCGCACAGATTACGCACAGGCGTTTCAGGACAGAGTGTCCA;

CH235.9_S54R:
                                        (SEQ ID NO: 14)
GGATCGACCCTAGGGGTGGTCGCACAG;

CH235.9_A61S:
                                        (SEQ ID NO: 15)
GTGGTCGCACAGATTACTCAGGGGCGTTTG.
```

Presence of mutations in plasmid products was confirmed by single-colony sequencing.

Structural Bioinformatics.

Average buried surface area (BSA) on gp120 was calculated for residues with BSA>1 $Å^2$ for the gp120-antibody complexes, and the corresponding antibody neutralization potencies were averaged for each of those residues based on data from neutralization assays. Spearman correlation between BSA on gp120 and antibody potencies was calculated for BSA cutoffs=0 to 85 $Å^2$ and potency $logIC_{50}$ cutoffs=0.60 to 1.62 μg/ml.

Sample Preparation for 5' RACE Method and 454 Pyrosequencing.

Human PBMCs ($6\times10^7$) were obtained from three HIV-1 and hepatitis C negative individuals (LP32647, LP08248 and LP23810). A 5'RACE approach was developed to amplify immunoglobulin genes based on previously described methods (Venturi et al., 2011). Briefly, the PBMCs were pelleted at 1200 rpm for 8 min. mRNA was then extracted and eluted in 50 μl elution buffer using MACS mRNA isolation kit (Miltenyi Biotec) according to manufacturer's instructions. To synthesize cDNA, 10 μl mRNA was mixed with 1 μl 5'CDS Oligo dT primers (12 μM) and incubated at 70° C. for 1 min and then −20° C. for 1 min. Then 1 μl SMARTER Oligo Primer (12 μM) (Clontech), 4 μl 5× RT buffer, 1 μl DTT 20 (20 mM), 1 μl dNTP (10 mM), 1 μl RNAse out and 1 μl SuperScript II reverse transcriptase (Invitrogen) were added to the reaction. After 2 hours incubation at 42° C., the cDNA products were purified using Nucleospin II kit (Macherey-Nagel) and eluted in 50 μl water. 454 pyrosequencing was performed as described previously (Wu et al., 2011). The first PCR amplification was performed with a common 5' primer II A (Clontech) and an Ig gene specific 3' primer (5'GGGGAAGACC-GATGGGCCCTTGGTGG3' (SEQ ID NO: 16)) using KAPA HIFI qPCR kit (Kapa Biosystems). The PCR products were purified with 2% Size Select Clonewell E-gel (Invitrogen) and Agencourt AMPure XP beads (Beckman Coulter). The second PCR amplification was performed with primers with 454 sequencing adapters (454-RACE-F: 5'CCATCT-CATCCCTGCGTGTCTCCGACTCAGAAGCAGTGGTAT-CAACGCAGAGT3' (SEQ ID NO: 17); 454-IgG-R: 5'CCTATCCCCTGTGTGCCTTGGCAGTCTCAGGGG-GAAGACCGATGGGCCCTTGGT GG3' (SEQ ID NO: 18)). The PCR products were again purified with 2% Size Select Clonewell E-gel and Agencourt AMPure XP beads.

Germline V Gene Specific Substitution Profile.

The raw reads from three healthy donors shorter than 300 nucleotides or longer than 600 nucleotides in length were not analyzed. Germline V gene was then assigned to each read using an in-house bioinformatics pipeline (Wu et al., 2015). We removed reads containing stop codons. Functional reads were then clustered using Usearch at 97% sequence identity, and one unique sequence was selected from each cluster to derive a curated dataset. To further reduce reads containing sequencing errors in the curated dataset, unique sequences having only one read in the clustering step were excluded. Finally, the curated dataset of the three donors were pooled for substitution frequency analyses.

Reads from the curated dataset that were assigned to germline V genes of interest were extracted, and were aligned using MUSCLE (Edgar, 2004). The amino acid substitution frequency or mutability of a V gene position was calculated by counting how many reads contain amino acids that are different from the germline V gene, and normalized by the total number of reads. We further calculated the frequency of the 19 types of amino acid substitutions at a position, which was used to generate positional substitution logo. The similarity of positional substitution frequency profiles between V genes of interest was measured by Pearson correlation coefficient.

Conformity Analysis.

The positional conformity of a conforming antibody sequence A to a reference sequence B is defined as the number of mutated positions shared by both sequences divided by the total number of mutations in the conforming sequence. Thus:

$$c_p(A; B) = \frac{|M_A \cap M_B|}{|M_A|}$$

where $M_i$ represents the set of amino acid positions in sequence i which are mutated from the germline V residue. Insertions and missing data are ignored, but deletions relative to the germline V are counted as mutations. For 8ANC131 and CH235 (Figure S3A):

$M_{8ANC131}$={2, 9, 10, 11, 16, 19, 20, 23, 26, 30, 31, 32, 33, 34, 37, 45, 46, 48, 50, 52, 53, 55, 57, 58, 59,60,62,63,66, 68,69,70,71,74,77, 80, 84, 85, 88, 89}

$M_{CH235}$={19, 23, 31, 34, 46, 47, 50, 52, 55, 57, 59, 63, 68, 83, 84}

$M_{8ANC131} \cap M_{CH235}$={19, 23, 31, 34, 46, 50, 52, 55, 57, 59, 63, 68, 84}

$c_p$(8ANC131, CH235)=13/15=86.7%

Identity conformity was defined the number of positionally conforming sites in conforming antibody A which were also mutated to the same residue as in the reference antibody B. Thus:

$$c_i(A; B) = \frac{\sum_{x \in \{M_A \cap M_B\}} \delta_{A_x B_x}}{|M_A|}$$

where δ is the Kronecker delta function and $A_x$ is the identity of the residue at position x of sequence A. For 8ANC131 and CH235 (Figure S3B): $c_i$(8ANC131, CH235)=4/15=26.7%

Targeting Precision of CD4bs-Directed Antibodies.

The targeting precision of the CD4bs-directed antibodies was defined as the buried surface area inside of the CD4 binding site minus the buried surface area outside of the CD4 binding site. The buried surface area of each antigen residue was determined by NACCESS. The buried surface area from the following residue numbers were considered inside of the CD4 binding site: 257, 279, 280, 281, 282, 283, 365, 366, 367, 368, 370, 371, 455, 456, 457, 458, 459, 460, 469, 472, 473, 474, 475, 476, and 477 (Zhou et al., 2007). The buried surface areas from the rest of the residues were considered outside of the CD4 binding site. Somatic hypermutation was defined using nucleotide sequences and P values were calculated based on linear regression.

Antibody Binding Orientation Calculation.

To calculate the relative rotation angles and translation to gp120-bound CD4 for gp120-bound CD4-binding site antibodies, all antibody-gp120 complexes to be analyzed were first superposed over the outer domain of gp120 (residue ranges: 252-392, 412-422, 437-476) with gp120 in its CD4 complex (PDB ID: 2NXY). The calculations of rotation angles and translation were then carried out with the gp120-aligned structures. For comparison of position of heavy chain variable domain relative to gp120-bound CD4, the frame work regions (residues 46-52, 56-59, 66-71 and 76-82) were superimposed to regions of CD4 domain 1 (residues 34-40, 43-46, 54-59, 65-71). The superposition procedures were performed with the Superpose Molecules module in CCP4 (Collaborative Computational Project, 1994). The Chi angle and distance between centroids in the Superpose output was taken as the rotation angle and translation distance between CD4 and a CD4-binding site antibody.

Supplemental References

Collaborative Computational Project (1994). The CCP4 suite: programs for protein crystallography. Acta Crystallogr., Sect D: Biol. Crystallogr. 50, 760-763.

Edgar, R. C. (2004). MUSCLE: multiple sequence alignment with high accuracy and high throughput. Nucleic Acids Res. 32, 1792-1797.

Giorgi, E. E., Funkhouser, B., Athreya, G., Perelson, A. S., Korber, B. T., Bhattacharya, T. (2010). Estimating time since infection in early homogeneous HIV-1 samples using a poisson model. BMC Bioinformatics 11, 532.

Gray, E. S., Moody, M. A., Wibmer, C. K., Chen, X., Marshall, D., Amos, J., Moore, P. L., Foulger, A., Yu, J. S., Lambson, B., et al. (2011). Isolation of a monoclonal antibody that targets the alpha-2 helix of gp120 and represents the initial autologous neutralizing-antibody response in an HIV-1 subtype C-infected individual. J. Virol. 85, 7719-7729.

Lander, G. C., Stagg, S. M., Voss, N. R., Cheng, A., Fellmann, D., Pulokas, J., Yoshioka, C., Irving, C., Mulder, A., Lau, P. W., et al. (2009). Appion: an integrated, database-driven pipeline to facilitate EM image processing. J. Struct. Biol. 166, 95-102.

Montefiori, D. C. (2005). Evaluating neutralizing antibodies against HIV, SIV, and SHIV in luciferase reporter gene assays. Current protocols in immunology/edited by John E Coligan [et al] Chapter 12, Unit 12 11.
Pettersen, E. F., Goddard, T. D., Huang, C. C., Couch, G. S., Greenblatt, D. M., Meng, E. C., and Ferrin, T. E. (2004). UCSF Chimera—a visualization system for exploratory research and analysis. J. Comput. Chem. 25, 1605-1612.
Scheres, S. H. (2012). A Bayesian view on cryo-EM structure determination. J. Mol. Biol. 415, 406-418.
Seaman, M. S., Janes, H., Hawkins, N., Grandpre, L. E., Devoy, C., Giri, A., Coffey, R. T., Harris, L., Wood, B., Daniels, M. G., et al. (2010). Tiered categorization of a diverse panel of HIV-1 Env pseudoviruses for assessment of neutralizing antibodies. J. Virol. 84, 1439-1452.
Schrodinger, LLC (2010). The PyMOL Molecular Graphics System, Version 1.3r1.
Suloway, C., Pulokas, J., Fellmann, D., Cheng, A., Guerra, F., Quispe, J., Stagg, S., Potter, C. S., and Carragher, B. (2005). Automated molecular microscopy: the new Leginon system. J. Struct. Biol. 151, 41-60.
Tang, G., Peng, L., Baldwin, P. R., Mann, D. S., Jiang, W., Rees, I., and Ludtke, S. J. (2007). EMAN2: an extensible image processing suite for electron microscopy. J. Struct. Biol. 157, 38-46.
Tomaras, G, D, Yates, N. L., Liu, P., Qin, L., Fouda, G. G., Chavez, L. L., Decamp, A. C., Parks, R. J., Ashley, V. C., Lucas, J. T., et al. (2008). Initial B-cell responses to transmitted human immunodeficiency virus type 1: virion-binding immunoglobulin M (IgM) and IgG antibodies followed by plasma anti-gp41 antibodies with ineffective control of initial viremia. J. Virol. 82, 12449-12463
van Dongen, J. J., Langerak, A. W., Bruggemann, M., Evans, P. A., Hummel, M., Lavender, F. L., Delabesse, E., Davi, F., Schuuring, E., Garcia-Sanz, R., et al. (2003). Design and standardization of PCR primers and protocols for detection of clonal immunoglobulin and T-cell receptor gene recombinations in suspect lymphoproliferations: report of the BIOMED-2 Concerted Action BMH4-CT98-3936. Leukemia 17, 2257-2317.
Venturi, V., Quigley, M. F., Greenaway, H. Y., Ng, P. C., Ende, Z. S., McIntosh, T., Asher, T. E., Almeida, J. R., Levy, S., Price, D. A., et al. (2011). A mechanism for TCR sharing between T cell subsets and individuals revealed by pyrosequencing. J Immunol. 186, 4285-4294.
Wu, X., Yang, Z. Y., Li, Y., Hogerkorp, C. M., Schief, W. R., Seaman, M. S., Zhou, T., Schmidt, S. D., Wu, L., Xu, L., et al. (2010). Rational design of envelope identifies broadly neutralizing human monoclonal antibodies to HIV-1. Science 329, 856-861.
Wu, X., Zhang, Z., Schramm, C. A., Joyce, M. G., Kwon, Y. D., Zhou, T., Sheng, Z., Zhang, B., O'Dell, S., McKee, K., et al. (2015). Maturation and Diversity of the VRC01-Antibody Lineage over 15 Years of Chronic HIV-1 Infection. Cell 161, 470-485.
Zhou, T., Xu, L., Dey, B., Hessell, A. J., Van Ryk, D., Xiang, S. H., Yang, X., Zhang, M. Y., Zwick, M. B., Arthos, J., et al. (2007). Structural definition of a conserved neutralization epitope on HIV-1 gp120. Nature 445, 732-737.

Accession Numbers

Coordinates and structure factors for CH235, CH235.9 and CH235.12 in complex with HIV-1 gp120 have been deposited with the Protein Data Bank (PDB ID 5F9W, 5F90 and 5F96). Next-generation sequencing data have been deposited with the NCBI Sequence Reads Archive (SRP067168). Antibody heavy and light chains have been deposited with GenBank (KU570032-KU570053).

Antibodies Names correlation: See supra.

References for Example 8

Alam, S. M., McAdams, M., Boren, D., Rak, M., Scearce, R. M., Gao, F., Camacho, Z. T., Gewirth, D., Kelsoe, G., Chen, P., et al. (2007). The role of antibody polyspecificity and lipid reactivity in binding of broadly neutralizing anti-HIV-1 envelope human monoclonal antibodies 2F5 and 4E10 to glycoprotein 41 membrane proximal envelope epitopes. J. Immunol. 178, 4424-4435.
Alam, S. M., Morelli, M., Dennison, S. M., Liao, H. X., Zhang, R., Xia, S. M., Rits-Volloch, S., Sun, L., Harrison, S. C., Haynes, B. F., et al. (2009). Role of HIV membrane in neutralization by two broadly neutralizing antibodies. Proc. Natl. Acad. Sci. U.S.A. 106, 20234-20239.
Bonsignori, M., Alam, S. M., Liao, H. X., Verkoczy, L., Tomaras, G. D., Haynes, B. F., and Moody, M. A. (2012). HIV-1 antibodies from infection and vaccination: insights for guiding vaccine design. Trends Microbiol. 20, 532-539.
Bonsignori, M., Hwang, K. K., Chen, X., Tsao, C. Y., Morris, L., Gray, E., Marshall, D. J., Crump, J. A., Kapiga, S. H., Sam, N. E., et al. (2011). Analysis of a clonal lineage of HIV-1 envelope V2/V3 conformational epitope-specific broadly neutralizing antibodies and their inferred unmutated common ancestors. J. Virol. 85, 9998-10009.
Bonsignori, M., Wiehe, K., Grimm, S. K., Lynch, R., Yang, G., Kozink, D. M., Perrin, F., Cooper, A. J., Hwang, K. K., Chen, X., et al. (2014). An autoreactive antibody from an SLE/HIV-1 individual broadly neutralizes HIV-1. J. Clin. Invest. 124, 1835-1843.
Boyd, S. D., Marshall, E. L., Merker, J. D., Maniar, J. M., Zhang, L. N., Sahaf, B., Jones, C. D., Simen, B. B., Hanczaruk, B., Nguyen, K. D., et al. (2009). Measurement and Clinical Monitoring of Human Lymphocyte Clonality by Massively Parallel V-D-J Pyrosequencing. Sci. Transl. Med. 1.
Dosenovic, P., von Boehmer, L., Escolano, A., Jardine, J., Freund, N. T., Gitlin, A. D., McGuire, A. T., Kulp, D. W., Oliveira, T., Scharf, L., et al. (2015). Immunization for HIV-1 Broadly Neutralizing Antibodies in Human Ig Knockin Mice. Cell 161, 1505-1515.
Felsenstein, J. (2005). PHYLIP (Phylogeny Inference Package), 3.6a3 edn (Seattle, Wash.: distributed by the author: Department of Genome Sciences, University of Washington).
Foote, J., and Milstein, C. (1991). Kinetic maturation of an immune response. Nature 352, 530-532.
Gao, F., Bonsignori, M., Liao, H. X., Kumar, A., Xia, S. M., Lu, X., Cai, F., Hwang, K. K., Song, H., Zhou, T., et al. (2014). Cooperation of B cell lineages in induction of HIV-1-broadly neutralizing antibodies. Cell 158, 481-491.
Georgiev, I. S., Doria-Rose, N. A., Zhou, T. Q., Do Kwon, Y., Staupe, R. P., Moquin, S., Chuang, G. Y., Louder, M. K., Schmidt, S. D., Altae-Tran, H. R., et al. (2013). Delineating Antibody Recognition in Polyclonal Sera from Patterns of HIV-1 Isolate Neutralization. Science 340, 751-756.
Haynes, B. F. (2015). New approaches to HIV vaccine development. Curr. Opin. Immunol. 35, 39-47.
Haynes, B. F., and Bradley, T. (2015). Broadly Neutralizing Antibodies and the Development of Vaccines. JAMA 313, 2419-2420.

Haynes, B. F., Fleming, J., St Clair, E. W., Katinger, H., Stiegler, G., Kunert, R., Robinson, J., Scearce, R. M., Plonk, K., Staats, H. F., et al. (2005). Cardiolipin polyspecific autoreactivity in two broadly neutralizing HIV-1 antibodies. Science 308, 1906-1908.

Haynes, B. F., Kelsoe, G., Harrison, S. C., and Kepler, T. B. (2012). B-cell-lineage immunogen design in vaccine development with HIV-1 as a case study. Nat. Biotechnol. 30, 423-433.

Haynes, B. F., and Verkoczy, L. (2014). AIDS/HIV. Host controls of HIV neutralizing antibodies. Science 344, 588-589.

Hraber, P., Korber, B., Wagh, K., Giorgi, E. E., Bhattacharya, T., Gnanakaran, S., Lapedes, A. S., Learn, G. H., Kreider, E. F., Li, Y., et al. (2015). Longitudinal Antigenic Sequences and Sites from Intra-Host Evolution (LASSIE) Identifies Immune-Selected HIV Variants. Viruses 7, 5443-5475.

Hraber, P., Seaman, M. S., Bailer, R. T., Mascola, J. R., Montefiori, D. C., and Korber, B. T. (2014). Prevalence of broadly neutralizing antibody responses during chronic HIV-1 infection. AIDS 28, 163-169.

Jardine, J., Julien, J. P., Menis, S., Ota, T., Kalyuzhniy, O., McGuire, A., Sok, D., Huang, P. S., MacPherson, S., Jones, M., et al. (2013). Rational HIV immunogen design to target specific germline B cell receptors. Science 340, 711-716.

Jardine, J. G., Ota, T., Sok, D., Pauthner, M., Kulp, D. W., Kalyuzhniy, O., Skog, P. D., Thinnes, T. C., Bhullar, D., Briney, B., et al. (2015). HIV-1 VACCINES. Priming a broadly neutralizing antibody response to HIV-1 using a germline-targeting immunogen. Science 349, 156-161.

Keele, B. F., Giorgi, E. E., Salazar-Gonzalez, J. F., Decker, J. M., Pham, K. T., Salazar, M. G., Sun, C., Grayson, T., Wang, S., Li, H., et al. (2008). Identification and characterization of transmitted and early founder virus envelopes in primary HIV-1 infection. Proc. Natl. Acad. Sci. U.S.A. 105, 7552-7557.

Kepler, T. B. (2013). Reconstructing a B-cell clonal lineage. I. Statistical inference of unobserved ancestors. F1000Res 2, 103.

Kepler, T. B., Munshaw, S., Wiehe, K., Zhang, R., Yu, J. S., Woods, C. W., Denny, T. N., Tomaras, G. D., Alam, S. M., Moody, M. A., et al. (2014). Reconstructing a B-Cell Clonal Lineage. II. Mutation, Selection, and Affinity Maturation. Front. Immunol. 5, 170.

Klein, F., Diskin, R., Scheid, J. F., Gaebler, C., Mouquet, H., Georgiev, I. S., Pancera, M., Zhou, T., Incesu, R. B., Fu, B. Z., et al. (2013). Somatic mutations of the immunoglobulin framework are generally required for broad and potent HIV-1 neutralization. Cell 153, 126-138.

Liao, H. X., Lynch, R., Zhou, T., Gao, F., Alam, S. M., Boyd, S. D., Fire, A. Z., Roskin, K. M., Schramm, C. A., Zhang, Z., et al. (2013). Co-evolution of a broadly neutralizing HIV-1 antibody and founder virus. Nature 496, 469-476.

Liu, M., Yang, G., Wiehe, K., Nicely, N. I., Vandergrift, N. A., Rountree, W., Bonsignori, M., Alam, S. M., Gao, J., Haynes, B. F., et al. (2015). Polyreactivity and autoreactivity among HIV-1 antibodies. J. Virol. 89, 784-798.

Mascola, J. R., and Haynes, B. F. (2013). HIV-1 neutralizing antibodies: understanding nature's pathways. Immunol. Rev. 254, 225-244.

McDonald, I. K., and Thornton, J. M. (1994). Satisfying hydrogen bonding potential in proteins. J. Mol. Biol. 238, 777-793.

McGuire, A. T., Hoot, S., Dreyer, A. M., Lippy, A., Stuart, A., Cohen, K. W., Jardine, J., Menis, S., Scheid, J. F., West, A. P., et al. (2013). Engineering HIV envelope protein to activate germline B cell receptors of broadly neutralizing anti-CD4 binding site antibodies. J. Exp. Med. 210, 655-663.

Otwinowski, Z., and Minor, W. (1997). Processing of X-ray diffraction data collected in oscillation mode. Method Enzymol. 276, 307-326.

Pugach, P., Ozorowski, G., Cupo, A., Ringe, R., Yasmeen, A., de Val, N., Derking, R., Kim, H. J., Korzun, J., Golabek, M., et al. (2015). A native-like SOSIP.664 trimer based on an HIV-1 subtype B env gene. J. Virol. 89, 3380-3395.

Rudicell, R. S., Do Kwon, Y., Ko, S. Y., Pegu, A., Louder, M. K., Georgiev, I. S., Wu, X. L., Zhu, J., Boyington, J. C., Chen, X. J., et al. (2014). Enhanced Potency of a Broadly Neutralizing HIV-1 Antibody In Vitro Improves Protection against Lentiviral Infection In Vivo. J. Virol. 88, 12669-12682.

Sanders, R. W., Derking, R., Cupo, A., Julien, J. P., Yasmeen, A., de Val, N., Kim, H. J., Blattner, C., de la Pena, A. T., Korzun, J., et al. (2013). A next-generation cleaved, soluble HIV-1 Env trimer, BG505 SOSIP.664 gp140, expresses multiple epitopes for broadly neutralizing but not non-neutralizing antibodies. PLoS Pathog. 9, e1003618.

Scheid, J. F., Mouquet, H., Feldhahn, N., Seaman, M. S., Velinzon, K., Pietzsch, J., Ott, R. G., Anthony, R. M., Zebroski, H., Hurley, A., et al. (2009). Broad diversity of neutralizing antibodies isolated from memory B cells in HIV-infected individuals. Nature 458, 636-640.

Scheid, J. F., Mouquet, H., Ueberheide, B., Diskin, R., Klein, F., Oliveira, T. Y., Pietzsch, J., Fenyo, D., Abadir, A., Velinzon, K., et al. (2011). Sequence and structural convergence of broad and potent HIV antibodies that mimic CD4 binding. Science 333, 1633-1637.

Sui, Z. W., Chen, Q. J., Wu, R., Zhang, H. B., Zheng, M., Wang, H. Z., and Chen, Z. (2010). Cross-protection against influenza virus infection by intranasal administration of M2-based vaccine with chitosan as an adjuvant. Arch. Virol. 155, 535-544.

Verkoczy, L., Chen, Y., Zhang, J., Bouton-Verville, H., Newman, A., Lockwood, B., Scearce, R. M., Montefiori, D. C., Dennison, S. M., Xia, S. M., et al. (2013). Induction of HIV-1 broad neutralizing antibodies in 2F5 knock-in mice: selection against membrane proximal external region-associated autoreactivity limits T-dependent responses. J. Immunol. 191, 2538-2550.

Verkoczy, L., Diaz, M., Holl, T. M., Ouyang, Y. B., Bouton-Verville, H., Alam, S. M., Liao, H. X., Kelsoe, G., and Haynes, B. F. (2010). Autoreactivity in an HIV-1 broadly reactive neutralizing antibody variable region heavy chain induces immunologic tolerance. Proc. Natl. Acad. Sci. U.S.A. 107, 181-186.

Verkoczy, L., Kelsoe, G., Moody, M. A., and Haynes, B. F. (2011). Role of immune mechanisms in induction of HIV-1 broadly neutralizing antibodies. Curr. Opin. Immunol. 23, 383-390.

Wu, X., Yang, Z. Y., Li, Y., Hogerkorp, C. M., Schief, W. R., Seaman, M. S., Zhou, T., Schmidt, S. D., Wu, L., Xu, L., et al. (2010). Rational design of envelope identifies broadly neutralizing human monoclonal antibodies to HIV-1. Science 329, 856-861.

Wu, X., Zhou, T., Zhu, J., Zhang, B., Georgiev, I., Wang, C., Chen, X., Longo, N. S., Louder, M., McKee, K., et al. (2011). Focused evolution of HIV-1 neutralizing antibodies revealed by structures and deep sequencing. Science 333, 1593-1602.

Yang, G., Holl, T. M., Liu, Y., Li, Y., Lu, X., Nicely, N. I., Kepler, T. B., Alam, S. M., Liao, H. X., Cain, D. W., et al. (2013). Identification of autoantigens recognized by the 2F5 and 4E10 broadly neutralizing HIV-1 antibodies. J. Exp. Med. 210, 241-256.

Zhou, T., Georgiev, I., Wu, X., Yang, Z. Y., Dai, K., Finzi, A., Kwon, Y. D., Scheid, J. F., Shi, W., Xu, L., et al. (2010). Structural basis for broad and potent neutralization of HIV-1 by antibody VRC01. Science 329, 811-817.

Zhou, T., Lynch, R. M., Chen, L., Acharya, P., Wu, X., Doria-Rose, N. A., Joyce, M. G., Lingwood, D., Soto, C., Bailer, R. T., et al. (2015). Structural Repertoire of HIV-1-Neutralizing Antibodies Targeting the CD4 Supersite in 14 Donors. Cell 161, 1280-1292.

Example 9: HIV-1 Envelope Trimers and Other Envelope Designs

This example shows that stabilized HIV-1 Env trimer immunogens show enhanced antigenicity for broadly neutralizing antibodies, and are not recognized by non-neutralizing antibodies. See also FIGS. 22-25 and 61-74. The example also describes additional envelope modifications and designs. In some embodiments these envelopes, including but not limited to trimers are further multimerized, and/or used as particulate, high-density array in liposomes or other particles, for example but not limited to nanoparticles. Any one of the envelopes of the invention could be designed and expressed as described herein.

A stabilized chimeric SOSIP.III design was used to generate 10 CH505 trimers. The CH505 TF SOSIP.III bound the CH103 UCA. Binding affinity of the CH103 lineage to the CH505 TF SOSIP.III correlates with neutralization potency against CH505 TF virus. This design was applicable to diverse viruses from multiple clades.

These results indicate that the native trimer on virions could have initiated the CH103 lineage during natural infection. CH103 recognizes all three protomers on the Env trimer. The SOSIP.III mimicked the native trimer on the virion in that stronger binding to it correlated with neutralization potency for the CH103 lineage. The SOSIP.III design enables soluble mimics of the native trimer to be tested as sequential immunogens in CH505 B cell lineage design vaccination. These trimers enable our efforts to utilize B cell lineage design with trimeric immunogens.

Elicitation of neutralizing antibodies is one goal for antibody-based vaccines. Neutralizing antibodies target the native trimeric HIV-1 Env on the surface virions. The trimeric HIV-1 envelope protein consists of three protomers each containing a gp120 and gp41 heterodimer. Recent immunogen design efforts have generated soluble near-native mimics of the Env trimer that bind to neutralizing antibodies but not non-neutralizing antibodies. The recapitulation of the native trimer could be a key component of vaccine induction of neutralizing antibodies. Neutralizing Abs target the native trimeric HIV-1 Env on the surface of viruses (Poignard et al. J Virol. 2003 January; 77(1):353-65; Parren et al. J Virol. 1998 December; 72(12):10270-4; Yang et al. J Virol. 2006 November; 80(22):11404-8.). The HIV-1 Env protein consists of three protomers of gp120 and gp41 heterodimers that are noncovalently linked together (Center et al. J Virol. 2002 August; 76(15):7863-7.). Soluble near-native trimers preferentially bind neutralizing antibodies as opposed to non-neutralizing antibodies (Sanders et al. PLoS Pathog. 2013 September; 9(9): e1003618).

Sequential Env vaccination has elicited broad neutralization in the plasma of one macaque (Example 5A). The overall goal of our project is to increase the frequence of vaccine induction of bnabs in the plasma of primates with sequential Env vaccination. We hypothesized that vaccination with sequential immunogens that target bnAb B cell lineage and mimic native trimers will increase the frequency of broadly neutralizing plasma antibodies. One goal is increase the frequency of vaccine induction of bnAb in the plasma of primates by sequential Env vaccination. It is expected that vaccination with sequential immunogens that target bnAb B cell lineages and mimic the native trimers on virions will increase the frequency of broadly neutralizing plasma antibodies.

Previous work has shown that CH505 derived soluble trimers are hard to produce. From a study published by Julien et al in 2015 (Proc Natl Acad Sci USA. 2015 Sep. 22; 112(38): 11947-11952.) it was shown that while CH505 produced comparable amounts of protein by transient transfection, only 5% of the CH505 protein formed trimer which 5 times lower than the gold standard viral strain BG505. Provided here are non-limiting embodiments of well-folded trimers for Env immunizations.

Near-native soluble trimers using the 6R.SOSIP.664 design are capable of generating autologous tier 2 neutralizing plasma antibodies in the plasma (Sanders et al. 2015), which provides a starting point for designing immunogens to elicit broadly neutralizing antibodies. While these trimers are preferentially antigenic for neutralizing antibodies they still possess the ability to expose the V3 loop, which generally results in strain-specific binding and neutralizing antibodies after vaccination. Using the unliganded structure the BG505.6R.SOSIP.664 has been stabilized by adding cysteines at position 201 and 433 to constrain the conformational flexibility such that the V3 loop is maintained unexposed (Kwon et al. Nat Struct Mol Biol. 2015 July; 22(7): 522-531.).

Immunogen design. Provided are engineered trimeric immunogens derived from multiple viruses from CH505. We generated chimeric 6R.SOSIP.664, chimeric disulfide stabilized (DS) 6R.SOSIP.664 (Kwon et al Nat Struct Mol Biol. 2015 July; 22(7): 522-531.), chimeric 6R.SOSIP.664v4.1 (DeTaeye et al. Cell. 2015 Dec. 17; 163(7):1702-15. doi: 10.1016/j.cell.2015.11.056), and chimeric 6R.SOSIP.664v4.2 (DeTaeye et al. Cell. 2015 Dec. 17; 163(7):1702-15. doi: 10.1016/j.cell.2015.11.056). The 6R.SOSIP.664 is the basis for all of these designs and is made as a chimera of C.CH0505 and A.BG505. The gp120 of C.CH505 was fused with the BG505 inner domain gp120 sequence within the alpha helix 5 (a5) to result in the chimeric protein. The chimeric gp120 is disulfide linked to the A.BG505 gp41 as outlined by Sanders et al. (PLoS Pathog. 2013 September; 9(9): e1003618). These immunogens were designed as chimeric proteins that possess the BG505 gp41 connected to the CH505 gp120, since the BG505 strain is particularly adept at forming well-folded, closed trimers (FIG. 22A). This envelope design retains the CH505 CD4 binding site that is targeted by the CH103 and CH235 broadly neutralizing antibody lineages that were isolated from CH505.

FIGS. 22 and 23 show nucleic acid and amino acid and sequences of various CH505 envelope trimer designs. FIG. 23 B shows an annotated sequence of the SOSIP.III design. Based on the various SOSIP designs, any other suitable envelope, for example but not limited to CH505 envelopes as described in WO2014042669 can be designed.

Recombinant envelopes as trimers could be produced and purified by any suitable method. For a non-limiting example of purification methods see Ringe R P, Yasmeen A, Ozorowski G, Go E P, Pritchard L K, Guttman M, Ketas T A, Cottrell C A, Wilson I A, Sanders R W, Cupo A, Crispin M, Lee K K, Desaire H, Ward A B, Klasse P J, Moore J P. 2015. Influences on the design and purification of soluble, recombinant native-like HIV-1 envelope glycoprotein trimers. J Virol 89:12189-12210. doi:10.1128/JVI.01768-15.

Multimeric Envelopes

Presentation of antigens as particulates reduces the B cell receptor affinity necessary for signal transduction and expansion (See Baptista et al. EMBO J. 2000 Feb. 15; 19(4): 513-520). Displaying multiple copies of the antigen on a particle provides an avidity effect that can overcome the low affinity between the antigen and B cell receptor. The initial B cell receptor specific for pathogens can be low affinity, which precludes vaccines from being able to stimulate and expand B cells of interest. In particular, very few naïve B cells from which HIV-1 broadly neutralizing antibodies arise can bind to soluble HIV-1 Envelope. Provided are envelopes, including but not limited to trimers as particulate, high-density array on liposomes or other particles, for example but not limited to nanoparticles. See e.g. He et al. Nature Communications 7, Article number: 12041 (2016), doi:10.1038/ncomms12041; Bamrungsap et al. Nanomedicine, 2012, 7 (8), 1253-1271.

To improve the interaction between the naïve B cell receptor and CH505 SOSIP trimer protein we created to two constructs that can be presented on particles. The first construct was made by fusing HIV-1 Envelope trimer CH505 to ferritin (See FIG. 24G). Ferritin protein self assembles into a small nanoparticle with three fold axis of symmetry. At these axis CH505 envelope protein was fused. Therefore the assembly of the three-fold axis also clusters three HIV-1 envelope protomers together to form an envelope trimer. Each ferritin particle has 6 axises which equates to 6 CH505 trimers being displayed per particle. See e.g. Sliepen et al. Retrovirology 201512:82, DOI: 10.1186/s12977-015-0210-4; See also FIG. 24H-J.

Another approach to multimerize expression constructs uses *Staphylococcus* Sortase A transpeptidase ligation to conjugate CH505 envelope trimers to cholesterol. The CH505 trimers can then be embedded into liposomes via the conjugated cholesterol. To conjugate the CH505 trimer to cholesterol either a C-terminal LPXTG tag (SEQ ID NO: 396) or a N-terminal pentaglycine repeat tag (SEQ ID NO: 307) was added to the CH505 envelope trimer gene. Cholesterol was also synthesized with these two tags. Sortase A was then used to covalently bond the tagged CH505 envelope to the cholesterol. The sortase A-tagged trimer protein can also be used to conjugate the trimer to other peptides, proteins, or fluorescent labels.

The invention provides design of envelopes and trimer designs wherein the envelope comprises a linker which permits addition of a lipid, such as but not limited to cholesterol, via a Sortase A reaction. See e.g. Tsukiji, S. and Nagamune, T. (2009), Sortase-Mediated Ligation: A Gift from Gram-Positive Bacteria to Protein Engineering. ChemBioChem, 10: 787-798. doi:10.1002/cbic.200800724; Proft, T. Sortase-mediated protein ligation: an emerging biotechnology tool for protein modification and immobilisation. Biotechnol Lett (2010) 32: 1. doi:10.1007/s10529-009-0116-0; Lena Schmohl, Dirk Schwarzer, Sortase-mediated ligations for the site-specific modification of proteins, Current Opinion in Chemical Biology, Volume 22, October 2014, Pages 122-128, ISSN 1367-5931, dx.doi.org/10.1016/j.cbpa.2014.09.020; Tabata et al. Anticancer Res. 2015 August; 35(8):4411-7.

The lipid modified envelopes and trimers could be formulated as liposomes. Any suitable liposome composition is contemplated.

Non-limiting embodiments of envelope designs for use in Sortase A reaction are shown in FIG. 24 B-D.

Design of Trimers with Readthrough Codons

The development of clonal cell lines that highly express trimeric HIV-1 Envelope will facilitate manufacturing of high quality proteins for clinical and research purposes. However, it is challenging to identify the cells that express trimeric protein among the many cells making various forms of HIV-1 Envelope with in the cell population. To identify cells expressing trimeric HIV-1 Envelope protein, we designed an expression construct that simultaneously produces both secreted Envelope protein as well as membrane anchored Envelope protein. The secreted Envelope protein can be purified using standard methods and results in unaltered soluble envelope. The membrane-anchored Envelope protein serves to mark the cells within a population of cells that expresses trimeric Envelope. More specifically, the trimeric Envelope expressing cells are sorted by fluorescence-activated cell sorting using a HIV-1 trimer specific antibody. The sorted cells can then be used to initiate clonal populations of cells that have been phenotypically shown to express the protein of interest.

The expression construct is designed by taking advantage of the amber stop codon UAG in messenger RNA. The codon UAG usually signifies the end of the polypeptide sequence, but at a low rate the ribosome can readthrough this stop codon and continue to elongate the polypeptide chain. We incorporated this stop codon into our protein construct followed by the natural BG505 gp41 transmembrane and cytoplasmic tail sequence ended with two stop codons. Therefore, when the stop codon is readthrough a membrane-anchored gp120/gp41 heterodimer is formed. Loughran et al. (2014) identified that the efficiency of readthrough could be increased by flanking the amber stop codon with the nucleotides CTA. Readthrough could be even further augmented with the addition of CTAG nucleotides after the amber stop codon. We engineered expression constructs with both modifications to ensure an optimal ratio of membrane-anchored and secreted trimeric Envelope protein. Since the CTAG creates a shift in reading frame we added GC nucleotides after the CTAG motif to preserve the original reading frame. The addition of CTAGGC results in the membrane anchored protein having a leucine and glycine residue expressed before the transmembrane domain. FIG. 24A shows non-limiting examples of readthrough designs. FIG. 24E and FIG. 24F show expression of "CTA" and "CTAGGC" designs in transiently transfected 293F cells. Any one of the envelopes of the invention could be designed and expressed as readthrough envelopes.

SEQUENCE LISTING (396 sequences)

SEQ ID NO: 1 - protein, 4 aa, Human immunodeficiency virus
REKR

SEQ ID NO: 2 - protein, 9 aa, Human immunodeficiency virus
RRVVEREKR

SEQ ID NO: 3 - protein, 9 aa, Artificial Sequence
  Description of Artificial Sequence: Synthetic peptide
ERVVEREKE

SEQ ID NO: 4 - protein, 4 aa, Artificial Sequence
  Description of Artificial Sequence: Synthetic peptide
SEKS

SEQ ID NO: 5 - protein, 79 aa, Human immunodeficiency virus
MRVMGIQRNYPQWWIWSMLGFWMLMICNGMWVTVYYGVPVWKEAKTTLFCASDAKAYEKEVHNVWATHACVPTDPNPQE

SEQ ID NO: 6 - protein, 33 aa, Artificial Sequence
  Description of Artificial Sequence: Synthetic polypeptide
TRPNNNTRKSIRIGPGQTFYATGDIIGNIRQAH

SEQ ID NO: 7 - protein, 24 aa, Homo sapiens
MPMGSLQPLATLYLLGMLVASVLA

SEQ ID NO: 8 - DNA, 38 bp, Artificial Sequence
  Description of Artificial Sequence: Synthetic primer
cgtggcgtctggatacaacttcaccgactactatatac

SEQ ID NO: 9 - DNA, 42 bp, Artificial Sequence
  Description of Artificial Sequence: Synthetic primer
cgtctggatacaacttcaacacctactatatacactgggtgc

SEQ ID NO: 10 - DNA, 32 bp, Artificial Sequence
  Description of Artificial Sequence: Synthetic primer
ggtcgcacagattacgcacaggcgtttgggga

SEQ ID NO: 11 - DNA, 34 bp, Artificial Sequence
  Description of Artificial Sequence: Synthetic primer
gattacgcaggggcgtttcaggacagagtgtcca

SEQ ID NO: 12 - DNA, 40 bp, Artificial Sequence
  Description of Artificial Sequence: Synthetic primer
gttagaaatgtgggaacggagggcagcttgctccactatg

SEQ ID NO: 13 - DNA, 43 bp, Artificial Sequence
  Description of Artificial Sequence: Synthetic primer
ggtcgcacagattacgcacaggcgtttcaggacagagtgtcca

SEQ ID NO: 14 - DNA, 27 bp, Artificial Sequence
  Description of Artificial Sequence: Synthetic primer
ggatcgaccctaggggtggtcgcacag

SEQ ID NO: 15 - DNA, 30 bp, Artificial Sequence
  Description of Artificial Sequence: Synthetic primer
gtggtcgcacagattactcaggggcgtttg

SEQ ID NO: 16 - DNA, 26 bp, Artificial Sequence
  Description of Artificial Sequence: Synthetic primer
ggggaagaccgatgggcccttggtgg

SEQ ID NO: 17 - DNA, 53 bp, Artificial Sequence
  Description of Artificial Sequence: Synthetic primer
ccatctcatccctgcgtgtctccgactcagaagcagtggtatcaacgcagagt

SEQ ID NO: 18 - DNA, 56 bp, Artificial Sequence
  Description of Artificial Sequence: Synthetic primer
cctatcccctgtgtgccttggcagtctcagggggaagaccgatgggcccttggtgg

SEQ ID NO: 19 - DNA, 32 bp, Artificial Sequence
  Description of Artificial Sequence: Synthetic oligonucleotide
tgatgaggtgaccgaattcgggacccggatcc

SEQ ID NO: 20 - DNA, 32 bp, Artificial Sequence
  Description of Artificial Sequence: Synthetic oligonucleotide
tgatgaggtgaccgaattcaggtcccggatcc

SEQ ID NO: 21 - DNA, 32 bp, Artificial Sequence
  Description of Artificial Sequence: Synthetic oligonucleotide
tgatgagggacccgaattcggtcaccggatcc

SEQ ID NO: 22 - DNA, 32 bp, Artificial Sequence
  Description of Artificial Sequence: Synthetic oligonucleotide
tgatgagggtcctgaattcggttaccggatcc

SEQ ID NO: 23 - DNA, 32 bp, Artificial Sequence
  Description of Artificial Sequence: Synthetic oligonucleotide
tgatgagaattcggtcaccgggtcctggatcc

SEQ ID NO: 24 - DNA, 32 bp, Artificial Sequence
  Description of Artificial Sequence: Synthetic oligonucleotide
tgatgagaattcggtgaccgggacctggatcc

SEQ ID NO: 25 - DNA, 2131 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaagaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtgaccgaattcgggacccggatcc

SEQ ID NO: 26 - DNA, 2131 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgaggtgaccgaattcaggtcccggatcc

SEQ ID NO: 27 - DNA, 2131 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacaactccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacgtccatccggatcggccctggccaggccttctacgccaccggccaggtgatcggcgacatccgcaaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggacccgaattcggtcaccggatcc

SEQ ID NO: 28 - DNA, 2131 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagatgaccccgctgtgcgtgaccctgaactgcaccaacgccaccgcgatcaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagagctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggtcctgaattcggttaccggatcc

SEQ ID NO: 29 - DNA, 2140 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgagctgcacgaacgccaccaacgcgacggcgtcgaactcgtccatcctcgaggggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacctccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacacggacaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagctgatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtcaccgggtcctggatcc

SEQ ID NO: 30 - DNA, 2143 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccgacgccaccgcgtccaacgcaaccgcgagcaacgccacggcgtcgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgtcgaacaacacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcggggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatgatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtgaccgggacctggatcc

SEQ ID NO: 31 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 32 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 33 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 34 - protein, 694 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKMTPLCVTLNCTNATAINSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKSYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 35 - protein, 698 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGNNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIGAQQHMLKLTVWGIKQLQARVLALERYLKDQQLLGMWGCSGKLICTTNVYWNSSWSNKTYGDIWDNMTWMQWEREISNYTEMIYELLEESQNQQEKNEQDLLALDRWNSLWNWFNITNWLWYIKIFIMIVGGLIGLRIIFAVLSLVNRVRQG

SEQ ID NO: 36 - protein, 697 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLSCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQG

SEQ ID NO: 37 - protein, 698 aa, Artificial Sequence; identical to SEQ ID NO: 35
  Description of Artificial Sequence: Synthetic polypeptide

SEQ ID NO: 38 - DNA, 32 bp, Artificial Sequence
  Description of Artificial Sequence: Synthetic oligonucleotide
tagtaaggtgaccgaattcgggacccggatcc

SEQ ID NO: 39 - DNA, 32 bp, Artificial Sequence
  Description of Artificial Sequence: Synthetic oligonucleotide
tagtaaggtgaccgaattcaggtcccggatcc

SEQ ID NO: 40 - DNA, 32 bp, Artificial Sequence
  Description of Artificial Sequence: Synthetic oligonucleotide
tagtaagggacccgaattcggtcaccggatcc

SEQ ID NO: 41 - DNA, 32 bp, Artificial Sequence
  Description of Artificial Sequence: Synthetic oligonucleotide
tagtaagggtcctgaattcggttaccggatcc

SEQ ID NO: 42 - DNA, 32 bp, Artificial Sequence
  Description of Artificial Sequence: Synthetic oligonucleotide
tagtaagaattcggtcaccgggtcctggatcc

SEQ ID NO: 43 - DNA, 32 bp, Artificial Sequence
  Description of Artificial Sequence: Synthetic oligonucleotide
tagtaagaattcggtgaccgggacctggatcc

SEQ ID NO: 44 - DNA, 1507 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaagaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtgaccgaattcgggacccggatcc

SEQ ID NO: 45 - DNA, 1507 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtgaccgaattcaggtcccggatcc

SEQ ID NO: 46 - DNA, 1507 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacaactccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacgtccatccggatcggccctggccaggccttctacgccaccggccaggtgatcggcgacatccgcaaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggacccgaattcggtcaccggatcc

SEQ ID NO: 47 - DNA, 1507 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagatgaccccgctgtgcgtgaccctgaactgcaccaacgccaccgcgatcaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggtcctgaattcggttaccggatcc

SEQ ID NO: 48 - DNA, 1516 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgagctgcacgaacgccaccaacgcgacggcgtcgaactcgtccatcctcgaggggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacctccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacacggacaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtcaccgggtcctggatcc

SEQ ID NO: 49 - DNA, 1519 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccgacgccaccgcgtccaacgcaaccgcgagcaacgccacggcgtcgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgtcgaacaacacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtgaccgggacctggatcc

SEQ ID NO: 50 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 51 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 52 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 53 - protein, 486 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKMTPLCVTLNCTNATAINSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARERVVEREKE

SEQ ID NO: 54 - protein, 489 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLSCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTFRPEGGNMKDNWRSELYKYKVVEVKPLGVAPTNARERVVEREKE

SEQ ID NO: 55 - protein, 490 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGNNNTETFRPGGGNMKDNWRSELYKYKVVEVKPLGVAPTNARERVVEREKE

SEQ ID NO: 56 - DNA, 2581 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaagaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaaggtgaccgaattcgggacccggatcc

SEQ ID NO: 57 - DNA, 2581 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaaggtgaccgaattcaggtcccggatcc

SEQ ID NO: 58 - DNA, 2581 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacaactccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacgtccatccggatcggccctggccaggccttctacgccaccggccaggtgatcggcgacatccgcaaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaagggacccgaattcggtcaccggatcc

SEQ ID NO: 59 - DNA, 2581 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagatgaccccgctgtgcgtgaccctgaactgcaccaacgccaccgcgatcaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagagctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaagggtcctgaattcggttaccggatcc

SEQ ID NO: 60 - DNA, 2590 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgagctgcacgaacgccaccaacgcgacggcgtcgaactcgtccatcctcgaggggatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctccgagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacctccaccgacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacacggacaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagctgatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggcgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggcaacctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaagaattcggtcaccgggtcctggatcc

SEQ ID NO: 61 - DNA, 2593 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccgacgccaccgcgtccaacgcaaccgcgagcaacgccacggcgtcgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgtcgaacaacacgcgcacctccatccggatcggccctggccaggccttctacgccaccggccaggtgatcggcgacatccgcgaggcgcactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcatcatcacgatccgctgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcggggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatgatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaagcgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgcgctgggcatctgccgcgccatccgcaacatccccacccgcatccgccagggcttcgagaccgccctcctgtagtaagaattcggtgaccgggacctggatcc

SEQ ID NO: 62 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 63 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 64 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 65 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKMTPLCVTLNCTNATAINSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKSYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 66 - protein, 849 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLSCTNATNATASNSSILEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNDTDTFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTELIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGNLVQYWGLELKRSAISLLDTLAIAVGEGTDRILEFVLGICRAIRNIPTRIRQGFETALL

SEQ ID NO: 67 - protein, 850 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGNNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIGAQQHMLKLTVWGIKQLQARVLALERYLKDQQLLGMWGCSGKLICTTNVYWNSSWSNKTYGDIWDNMTWMQWEREISNYTEMIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRKRSTRLVSGFLALVWDDLRSLCLFIYHRLRDFILIAARAGELLGRSSLKGLRRGWEALKYLGSLVQYWGLELKRSAISLLDTLAIAVGEGTDRILEFALGICRAIRNIPTRIRQGFETALL

SEQ ID NO: 68 - DNA, 32 bp, Artificial Sequence; identical to SEQ ID NO: 19
  Description of Artificial Sequence: Synthetic oligonucleotide

SEQ ID NO: 69 - DNA, 32 bp, Artificial Sequence; identical to SEQ ID NO: 20
  Description of Artificial Sequence: Synthetic oligonucleotide

SEQ ID NO: 70 - DNA, 32 bp, Artificial Sequence; identical to SEQ ID NO: 21
  Description of Artificial Sequence: Synthetic oligonucleotide

SEQ ID NO: 71 - DNA, 32 bp, Artificial Sequence; identical to SEQ ID NO: 22
  Description of Artificial Sequence: Synthetic oligonucleotide

SEQ ID NO: 72 - DNA, 32 bp, Artificial Sequence; identical to SEQ ID NO: 23
  Description of Artificial Sequence: Synthetic oligonucleotide

SEQ ID NO: 73 - DNA, 32 bp, Artificial Sequence
  Description of Artificial Sequence: Synthetic oligonucleotide
tgatgagaattcggtgaccgggtcccggatcc

SEQ ID NO: 74 - DNA, 32 bp, Artificial Sequence
  Description of Artificial Sequence: Synthetic oligonucleotide
tgatgagggtcccgaattcggttaccggatcc

SEQ ID NO: 75 - DNA, 32 bp, Artificial Sequence
  Description of Artificial Sequence: Synthetic oligonucleotide
tgatgagaattcggtaaccaggtcccggatcc

SEQ ID NO: 76 - DNA, 32 bp, Artificial Sequence
  Description of Artificial Sequence: Synthetic oligonucleotide
tgatgaggtaaccgggacccgaattcggatcc

SEQ ID NO: 77 - DNA, 32 bp, Artificial Sequence; identical to SEQ ID NO: 24
  Description of Artificial Sequence: Synthetic oligonucleotide

SEQ ID NO: 78 - DNA, 2131 bp, Artificial Sequence; identical to SEQ ID NO: 25
  Description of Artificial Sequence: Synthetic polynucleotide

SEQ ID NO: 79 - DNA, 2131 bp, Artificial Sequence; identical to SEQ ID NO: 26
  Description of Artificial Sequence: Synthetic polynucleotide

SEQ ID NO: 80 - DNA, 2131 bp, Artificial Sequence; identical to SEQ ID NO: 27
  Description of Artificial Sequence: Synthetic polynucleotide

SEQ ID NO: 81 - DNA, 2131 bp, Artificial Sequence; identical to SEQ ID NO: 28
  Description of Artificial Sequence: Synthetic polynucleotide

SEQ ID NO: 82 - DNA, 2140 bp, Artificial Sequence; identical to SEQ ID NO: 29
  Description of Artificial Sequence: Synthetic polynucleotide

SEQ ID NO: 83 - DNA, 2186 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaacgccaccgcgtccaactcctctatcatcgaggggatgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctcggagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacgtccaccgacatggccaactccaccgagaccaactccacgcgcatcatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtgaccgggtcccggatccagatctgctgtgcctt

SEQ ID NO: 84 - DNA, 2159 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgacgaacgccaccgcgtccaactcgtccatcatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacacggcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcgagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggtcccgaattcggttaccggatccagatctgctgtgcctt

SEQ ID NO: 85 - DNA, 2153 bp, Artificial Sequence
  Description of Artificial Sequence: Synthetic polynucleotide
gtcgacaagaagccaccatgcgcgtgacgggcatccagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcatcgacgccaacgcgaccgcgtccaacgcgacggcatccaactcgtccatcatcgaggggatgaagaactgctccttcaacatcacgacggagctgcgcgacaagatcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacgaacagcgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcacgatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacaccacggagaccttcaggccagggggaggcaacatgaaggacaactggcgctccgagctgtacaagtacaaggtggtggagatcaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccgactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaattcggtaaccaggtcccggatccagatctgctgtgcctt

SEQ ID NO: 86 - DNA, 2198 bp, Artificial Sequence
  Description of Artificial Sequence: Synthetic polynucleotide
gtcgacaagaagccaccatgaaggtgcggggcatccagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctggagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcacggacgccaacgccaccgcgtcgaacaccaacgcgaccgcaagcaacatcaacgcgacggcgtcgaagtcctccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacagcaagaccatcatcgtgcacctgaacgagtccgtgaagatcgagtgcacccgcccgagcaacaacacgcgcacctccatccggatcggccctggccaggccttctacgccaccggccaagtgatcggcgacatccgcgaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctgcactgccgcatcaagcagatcatcaacatgtggcaggaggtgggccgcgccatgtacgcaccgcccatcgccggcaacatcacctgcatctccaacatcaccggcctcctgctgacccgcgacggcggcgagaacacccgggacggaggcaacaacaacacggagaccttcaggccagagggaggcaacatgaaggacaactggcgctccgagctgtacaagtacaaggtggtggaggtgaagcccctgggcgtggcacccaccaaggcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgacatcatctacgacctcctcgaggagtcccagaaccagcaggagaagaacgagcaggatctgctcgcgctggaccgctggaactccctgtggaactggttcaacatcaccaagtggctgtggtacatcaagatcttcatcatgatcgtgggcggcctgatcggcctgcgcatcatcttcgccgtgctgtcgctggtgaaccgcgtgcgccagggctgatgaggtaaccgggacccgaattcggatccagatctgctgtgcctt

SEQ ID NO: 87 - DNA, 2143 bp, Artificial Sequence; identical to SEQ ID NO: 30
  Description of Artificial Sequence: Synthetic polynucleotide

SEQ ID NO: 88 - protein, 694 aa, Artificial Sequence; identical to SEQ ID NO: 31
  Description of Artificial Sequence: Synthetic polypeptide

SEQ ID NO: 89 - protein, 694 aa, Artificial Sequence; identical to SEQ ID NO: 32
  Description of Artificial Sequence: Synthetic polypeptide

SEQ ID NO: 90 - protein, 694 aa, Artificial Sequence; identical to SEQ ID NO: 33
  Description of Artificial Sequence: Synthetic polypeptide

SEQ ID NO: 91 - protein, 694 aa, Artificial Sequence; identical to SEQ ID NO: 34
  Description of Artificial Sequence: Synthetic polypeptide

SEQ ID NO: 92 - protein, 698 aa, Artificial Sequence; identical to SEQ ID NO: 35
  Description of Artificial Sequence: Synthetic polypeptide

SEQ ID NO: 93 - protein, 707 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 94 - protein, 698 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNTAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGENNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 95 - protein, 696 aa, Artificial Sequence
  Description of Artificial Sequence: Synthetic polypeptide
MRVTGIQRNYPQWWIWSMLGLWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGNNNTTETFRPGGGNMKDNWRSELYKYKVVEIKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISDYTEIIYELLEESQNQQEKNEQDLLALDRWNSLWNWFNITNWLWYIKIFIMIVGGLIGLRIIFAVLSLVNRVRQG

SEQ ID NO: 96 - protein, 711 aa, Artificial Sequence
  Description of Artificial Sequence: Synthetic polypeptide
MKVRGIQRNYPQWWIWSMLGLWMLMICNGMWVTVYYGVPVWKEAKTTLFCASDAKAYEKEVHNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYDLLEESQNQQEKNEQDLLALDRWNSLWNWFNITKWLWYIKIFIMIVGGLIGLRIIFAVLSLVNRVRQG

SEQ ID NO: 97 - protein, 697 aa, Artificial Sequence; identical to SEQ ID NO: 36
  Description of Artificial Sequence: Synthetic polypeptide

SEQ ID NO: 98 - protein, 698 aa, Artificial Sequence; identical to SEQ ID NO: 35
  Description of Artificial Sequence: Synthetic polypeptide

SEQ ID NO: 99 - DNA, 32 bp, Artificial Sequence; identical to SEQ ID NO: 38
  Description of Artificial Sequence: Synthetic oligonucleotide

SEQ ID NO: 100 - DNA, 32 bp, Artificial Sequence; identical to SEQ ID NO: 39
  Description of Artificial Sequence: Synthetic oligonucleotide

SEQ ID NO: 101 - DNA, 32 bp, Artificial Sequence; identical to SEQ ID NO: 40
  Description of Artificial Sequence: Synthetic oligonucleotide

SEQ ID NO: 102 - DNA, 32 bp, Artificial Sequence; identical to SEQ ID NO: 41
  Description of Artificial Sequence: Synthetic oligonucleotide

SEQ ID NO: 103 - DNA, 32 bp, Artificial Sequence; identical to SEQ ID NO: 42
  Description of Artificial Sequence: Synthetic oligonucleotide

SEQ ID NO: 104 - DNA, 32 bp, Artificial Sequence
  Description of Artificial Sequence: Synthetic oligonucleotide
tagtaagaattcggtgaccgggtcccggatcc

SEQ ID NO: 105 - DNA, 1507 bp, Artificial Sequence; identical to SEQ ID NO: 44
  Description of Artificial Sequence: Synthetic polynucleotide

SEQ ID NO: 106 - DNA, 1507 bp, Artificial Sequence; identical to SEQ ID NO: 45
  Description of Artificial Sequence: Synthetic polynucleotide

SEQ ID NO: 107 - DNA, 1507 bp, Artificial Sequence; identical to SEQ ID NO: 46
  Description of Artificial Sequence: Synthetic polynucleotide

SEQ ID NO: 108 - DNA, 1507 bp, Artificial Sequence; identical to SEQ ID NO: 47
  Description of Artificial Sequence: Synthetic polynucleotide

SEQ ID NO: 109 - DNA, 1516 bp, Artificial Sequence; identical to SEQ ID NO: 48
  Description of Artificial Sequence: Synthetic polynucleotide

SEQ ID NO: 110 - DNA, 1546 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaacgccaccgcgtccaactcctctatcatcgaggggatgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctcggagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacgtccaccgacatggccaactccaccgagaccaactccacgcgcatcatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagaattcggtgaccgggtcccggatcc

SEQ ID NO: 111 - DNA, 1521 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgacgaacgccaccgcgtccaactcgtccatcatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacacggcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcgagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggtcccgaattcggttaccggatcc

SEQ ID NO: 112 - DNA, 1513 bp, Artificial Sequence
  Description of Artificial Sequence: Synthetic polynucleotide
gtcgacaagaagccaccatgcgcgtgacgggcatccagcgcaactacccgcagtggtggatctggtcgatgctgggcctctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcatcgacgccaacgcgaccgcgtccaacgcgacggcatccaactcgtccatcatcgaggggatgaagaactgctccttcaacatcacgacggagctgcgcgacaagatcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacgaacagcgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcacgatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacaccacggagaccttcaggccagggggaggcaacatgaaggacaactggcgctccgagctgtacaagtacaaggtggtggagatcaagcccctgggcgtggcacccaccaacgcccgcgagcgcgtcgtggagcgcgagaaggagtagtaagaattcggtaaccaggtcccggatcc

SEQ ID NO: 113 - DNA, 1558 bp, Artificial Sequence
  Description of Artificial Sequence: Synthetic polynucleotide
gtcgacaagaagccaccatgaaggtgcggggcatccagcgcaactacccgcagtggtggatctggtcgatgctgggcctctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctggagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcacggacgccaacgccaccgcgtcgaacaccaacgcgaccgcaagcaacatcaacgcgacggcgtcgaagtcctccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacagcaagaccatcatcgtgcacctgaacgagtccgtgaagatcgagtgcacccgcccgagcaacaacacgcgcacctccatccggatcggccctggccaggccttctacgccaccggccaagtgatcggcgacatccgcgaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctgcactgccgcatcaagcagatcatcaacatgtggcaggaggtgggccgcgccatgtacgcaccgcccatcgccggcaacatcacctgcatctccaacatcaccggcctcctgctgacccgcgacggcggcgagaacacccgggacggaggcaacaacaacacggagaccttcaggccagagggaggcaacatgaaggacaactggcgctccgagctgtacaagtacaaggtggtggaggtgaagcccctgggcgtggcacccaccaaggcccgcgagcgcgtcgtggagcgcgagaaggagtagtaaggtaaccgggacccgaattcggatcc

SEQ ID NO: 114 - DNA, 1519 bp, Artificial Sequence; identical to SEQ ID NO: 49
  Description of Artificial Sequence: Synthetic polynucleotide

SEQ ID NO: 115 - protein, 486 aa, Artificial Sequence; identical to SEQ ID NO: 50
  Description of Artificial Sequence: Synthetic polypeptide

SEQ ID NO: 116 - protein, 486 aa, Artificial Sequence; identical to SEQ ID NO: 51
  Description of Artificial Sequence: Synthetic polypeptide

SEQ ID NO: 117 - protein, 486 aa, Artificial Sequence; identical to SEQ ID NO: 52
  Description of Artificial Sequence: Synthetic polypeptide

SEQ ID NO: 118 - protein, 486 aa, Artificial Sequence; identical to SEQ ID NO: 53
  Description of Artificial Sequence: Synthetic polypeptide

SEQ ID NO: 119 - protein, 489 aa, Artificial Sequence; identical to SEQ ID NO: 54
  Description of Artificial Sequence: Synthetic polypeptide

SEQ ID NO: 120 - protein, 499 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARERVVEREKE

SEQ ID NO: 121 - protein, 490 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNTAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGENNTETFRPGGGNMKDNWRSELYKYKVVEVKPLGVAPTNARERVVEREKE

SEQ ID NO: 122 - protein, 488 aa, Artificial Sequence
  Description of Artificial Sequence: Synthetic polypeptide
MRVTGIQRNYPQWWIWSMLGLWMLMICNGVPVWKEAKTTLFCASDAKAYEKEVHNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGNNNTTETFRPGGGNMKDNWRSELYKYKVVEIKPLGVAPTNARERVVEREKE

SEQ ID NO: 123 - protein, 503 aa, Artificial Sequence
  Description of Artificial Sequence: Synthetic polypeptide
MKVRGIQRNYPQWWIWSMLGLWMLMICNGVPVWKEAKTTLFCASDAKAYEKEVHNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARERVVEREKE

SEQ ID NO: 124 - protein, 490 aa, Artificial Sequence; identical to SEQ ID NO: 55
  Description of Artificial Sequence: Synthetic polypeptide

SEQ ID NO: 125 - DNA, 2581 bp, Artificial Sequence; identical to SEQ ID NO: 56
  Description of Artificial Sequence: Synthetic polynucleotide

SEQ ID NO: 126 - DNA, 2581 bp, Artificial Sequence; identical to SEQ ID NO: 57
  Description of Artificial Sequence: Synthetic polynucleotide

SEQ ID NO: 127 - DNA, 2581 bp, Artificial Sequence; identical to SEQ ID NO: 58
  Description of Artificial Sequence: Synthetic polynucleotide

SEQ ID NO: 128 - DNA, 2581 bp, Artificial Sequence; identical to SEQ ID NO: 59
  Description of Artificial Sequence: Synthetic polynucleotide

SEQ ID NO: 129 - DNA, 2590 bp, Artificial Sequence; identical to SEQ ID NO: 60
  Description of Artificial Sequence: Synthetic polynucleotide

SEQ ID NO: 130 - DNA, 2620 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaacgccaccgcgtccaactcctctatcatcgaggggatgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctcggagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacgtccaccgacatggccaactccaccgagaccaactccacgcgcatcatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggcgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaagaattcggtgaccgggtcccggatcc

SEQ ID NO: 131 - DNA, 2593 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgacgaacgccaccgcgtccaactcgtccatcatcgaggagatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacacggcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcgagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaagggtcccgaattcggttaccggatcc

SEQ ID NO: 132 - DNA, 2587 bp, Artificial Sequence
  Description of Artificial Sequence: Synthetic polynucleotide
gtcgacaagaaatgcgcgtgacgggcatccagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcatcgacgccaacgcgaccgcgtccaacgcgacggcatccaactcgtccatcatcgaggggatgaagaactgctccttcaacatcacgacggagctgcgcgacaagatcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacgaacagcgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcacgatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacaccacggagaccttcaggccagggggaggcaacatgaaggacaactggcgctccgagctgtacaagtacaaggtggtggagatcaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccgactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgacgccctccccccggggcccggacaggcccggtggcatcgaggaggagggcggcgagcaggaccgcaaccgctccacgcgcctggtgtccggcttcctggccctggcgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggcggcctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaagaattcggtaaccaggtcccggatcc

SEQ ID NO: 133 - DNA, 2632 bp, Artificial Sequence
  Description of Artificial Sequence: Synthetic polynucleotide
gtcgacaagaaatgaaggtgcggggcatccagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctggagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcacggacgccaacgccaccgcgtcgaacaccaacgcgaccgcaagcaacatcaacgcgacggcgtcgaagtcctccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacagcaagaccatcatcgtgcacctgaacgagtccgtgaagatcgagtgcacccgcccgagcaacaacacgcgcacctccatccggatcggccctggccaggccttctacgccaccggccaagtgatcggcgacatccgcgaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctgcactgccgcatcaagcagatcatcaacatgtggcaggaggtgggccgcgccatgtacgcaccgcccatcgccggcaacatcacctgcatctccaacatcaccggcctcctgctgacccgcgacggcggcgagaacacccgggacggaggcaacaacaacacggagaccttcaggccagagggaggcaacatgaaggacaactggcgctccgagctgtacaagtacaaggtggtggaggtgaagcccctgggcgtggcacccaccaaggcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgacatcatctacgacctcctcgaggagtcccagaaccagcaggagaagaacgagcaggatctgctcgcgctggaccgctggaactccctgtggaactggttcaacatcaccaagtggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggcgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggcgggctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaaggtaaccgggacccgaattcggatcc

SEQ ID NO: 134 - DNA, 2593 bp, Artificial Sequence; identical to SEQ ID NO: 61
  Description of Artificial Sequence: Synthetic polynucleotide

SEQ ID NO: 135 - protein, 846 aa, Artificial Sequence; identical to SEQ ID NO: 62
  Description of Artificial Sequence: Synthetic polypeptide

SEQ ID NO: 136 - protein, 846 aa, Artificial Sequence; identical to SEQ ID NO: 63
  Description of Artificial Sequence: Synthetic polypeptide

SEQ ID NO: 137 - protein, 846 aa, Artificial Sequence; identical to SEQ ID NO: 64
  Description of Artificial Sequence: Synthetic polypeptide

SEQ ID NO: 138 - protein, 846 aa, Artificial Sequence; identical to SEQ ID NO: 65
  Description of Artificial Sequence: Synthetic polypeptide

SEQ ID NO: 139 - protein, 849 aa, Artificial Sequence; identical to SEQ ID NO: 66
  Description of Artificial Sequence: Synthetic polypeptide

SEQ ID NO: 140 - protein, 859 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 141 - protein, 850 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEEMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNTAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGENNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 142 - protein, 848 aa, Artificial Sequence
  Description of Artificial Sequence: Synthetic polypeptide
MRVTGIQRNYPQWWIWSMLGLWMLMICNGMWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGNNNTTETFRPGGGNMKDNWRSELYKYKVVEIKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISDYTEIIYELLEESQNQQEKNEQDLLALDRWNSLWNWFNITNWLWYIKIFIMIVGGLIGLRIIFAVLSLVNRVRQGYSPLSLQTLTPSPRGPDRPGGIEEEGGEQDRNRSTRLVSGFLALAWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 143 - protein, 863 aa, Artificial Sequence
  Description of Artificial Sequence: Synthetic polypeptide
MKVRGIQRNYPQWWIWSMLGLWMLMICNGMWVTVYYGVPVWKEAKTTLFCASDAKAYEKEVHNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVEVKPLGVAPTKARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTDIIYDLLEESQNQQEKNEQDLLALDRWNSLWNWFNITKWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGGLVQYWGLELKRSAISLLDTLAIAVGEGTDRILEFVLGICRAIRNIPTRIRQGFETALL

SEQ ID NO: 144 - protein, 850 aa, Artificial Sequence; identical to SEQ ID NO: 67
  Description of Artificial Sequence: Synthetic polypeptide

SEQ ID NO: 145 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaagaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtgaccgaattcgggacccggatcc

SEQ ID NO: 146 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtgaccgaattcaggtcccggatcc

SEQ ID NO: 147 - DNA, 1509 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacaactccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacgtccatccggatcggccctggccaggccttctacgccaccggccaggtgatcggcgacatccgcaaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggacccgaattcggtcaccggatcc

SEQ ID NO: 148 - DNA, 1542 bp, Artificial Sequence
  Description of Artificial Sequence: Synthetic polynucleotide
gtgtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacacgagggacggaggcaagaacaacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtagtaagggtcctgaattcggtaaccggatcc

SEQ ID NO: 149 - DNA, 1514 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgagcaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaacatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacacggagaccttcaggccaggcggaggcaacatgaaggacaactggcgctccgagctgtacaagtacaaggtggtggaggtgaagcccctgggcgtggcacccaccaacgcccgcgagcgcgtcgtggagcgcgagaaggagtgatagtaagaggtcccggtaaccggatcc

SEQ ID NO: 150 - DNA, 1522 bp, Artificial Sequence
  Description of Artificial Sequence: Synthetic polynucleotide
gtcgacaagaagccaccatgcgcgtgcgcggcatccagcgcagctacccgcagtggtggatctggtcgatgctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaactccaacatcctcgaggggatgaagaactgctccttcaacatcacgacggagctgcgcgacaagcgcgagaagaagaacgccctgttctacaagctggacatcgtgcagctgggcggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaagaagtacttccccgacaagaacatcaccttccggccgtcgtccggcggcgacctcgagatcaccacgcactccttcaactgcggtggcgagttcttctactgcaacacgtcgtccctgttcaaccgcacctacatggcgacgtccaccgacatggccaactccaccgagacgaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcgagcgcgtcgtggagcgcgagaaggagtagtaaggtcaccgggtcccgaattcggatcc

SEQ ID NO: 151 - protein, 486 aa, Artificial Sequence; identical to SEQ ID NO: 50
  Description of Artificial Sequence: Synthetic polypeptide

SEQ ID NO: 152 - protein, 486 aa, Artificial Sequence; identical to SEQ ID NO: 51
  Description of Artificial Sequence: Synthetic polypeptide

SEQ ID NO: 153 - protein, 486 aa, Artificial Sequence; identical to SEQ ID NO: 52
  Description of Artificial Sequence: Synthetic polypeptide

SEQ ID NO: 154 - protein, 497 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNTRDGGKNNTETFRPGGGNMKDNWRSELYKYKVVEVKPLGVAPTNARERVVEREKE

SEQ ID NO: 155 - protein, 489 aa, Artificial Sequence
  Description of Artificial Sequence: Synthetic polypeptide
MRVMGIQRNYPQWWIWSMLGFWMLMICNGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDGGKNDTETFRPGGGNMKDNWRSELYKYKVVEVKPLGVAPTNARERVVEREKE

SEQ ID NO: 156 - protein, 491 aa, Artificial Sequence
  Description of Artificial Sequence: Synthetic polypeptide
MRVRGIQRSYPQWWIWSMLGFWMLMICNGVPVWKEAKTTLFCASDAKAYEKEVHNVWATHACVPTDPNPQEMVLKNVTENFNMWENDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARERVVEREKE

SEQ ID NO: 157 - DNA, 2582 bp, Artificial Sequence
  Description of Artificial Sequence: Synthetic polynucleotide
ggtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaagaacgtgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaaggtgaccgaattcgggacccggatcc

SEQ ID NO: 158 - DNA, 2582 bp, Artificial Sequence
  Description of Artificial Sequence: Synthetic polynucleotide
ggtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcaacgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaaggtgaccgaattcaggtcccggatcc

SEQ ID NO: 159 - DNA, 2582 bp, Artificial Sequence
  Description of Artificial Sequence: Synthetic polynucleotide
ggtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacaactccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacgtccatccggatcggccctggccaggccttctacgccaccggccaggtgatcggcgacatccgcaaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaagggacccgaattcggtcaccggatcc

SEQ ID NO: 160 - DNA, 2615 bp, Artificial Sequence
  Description of Artificial Sequence: Synthetic polynucleotide
ggtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacacgagggacggaggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggcgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaagggtcctgaattcggtaaccggatcc

SEQ ID NO: 161 - DNA, 2592 bp, Artificial Sequence
  Description of Artificial Sequence: Synthetic polynucleotide
ggtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgagcaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaacatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggtgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtgatgagaggtcccggtaaccggatcc

SEQ ID NO: 162 - DNA, 2597 bp, Artificial Sequence
  Description of Artificial Sequence: Synthetic polynucleotide
ggtcgacaagaaatgcgcgtgcgcggcatccagcgcagctacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtgggagaacgacatggtggaccagatgcacgaggacgtgatctccctgtgggaccagtccctgaagccctgcgtgaagctgaccccgctgtgcgtgaccctgaactgcatcaacgccaccaacgcgacggactcgaactccaacatcctcgaggggatgaagaactgctccttcaacatcacgacggagctgcgcgacaagcgcgagaagaagaacgccctgttctacaagctggacatcgtgcagctgggcggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcgaagaacatcacggacaacagcaagaccatcatcgtgcacctgaacgagtccgtgaagatcgagtgcacccgcccgagcaacaacacgcgcacctccatccggatcggccctggccaggccttctacgccaccggccaggtgatcggcaacatccgcgaggcgcactgcaacatctccgagtccaagtggaacgagaccctgcagcgcgtgtccgagaagctgaagaagtacttccccgacaagaacatcaccttccggccgtcgtccggcggcgacctcgagatcaccacgcactccttcaactgcggtggcgagttcttctactgcaacacgtcgtccctgttcaaccgcacctacatggcgacgtccaccgacatggccaactccaccgagacgaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacacggaggacacggagaccttcaggccagagggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagcgcgagatctccaactacaccaacatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaaccgctccacgcgcctggtgtccggcttcctggccctggcgtgggacgacctgcgctccctgtgcctgttcatctaccaccgcctgcgcgacttcatcctgatcgcggcccgcgctggcgagctgctgggccggtcctcgctgaagggcctgcgccgcggctgggaggccctgaagtacctgggctcgctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtagtaaggtcaccgggtcccgaattcggatcc

SEQ ID NO: 163 - protein, 846 aa, Artificial Sequence; identical to SEQ ID NO: 62
  Description of Artificial Sequence: Synthetic polypeptide

SEQ ID NO: 164 - protein, 846 aa, Artificial Sequence; identical to SEQ ID NO: 63
  Description of Artificial Sequence: Synthetic polypeptide

SEQ ID NO: 165 - protein, 846 aa, Artificial Sequence; identical to SEQ ID NO: 64
  Description of Artificial Sequence: Synthetic polypeptide

SEQ ID NO: 166 - protein, 857 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 167 - protein, 849 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDGGKNDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFILGICRAIRNIPTRIRQGFETALL

SEQ ID NO: 168 - protein, 851 aa, Artificial Sequence
  Description of Artificial Sequence: Synthetic polypeptide
MRVRGIQRSYPQWWIWSMLGFWMLMICNGMWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCINATNATDSNSNILEGMKNCSFNITTELRDKREKKNALFYKLDIVQLGGNSSQYRLINCNTSVITQACPKVSFDPIPIHYCAPAGYAILKCNNKTFNGTGPCNNVSTVQCTHGIKPVVSTQLLLNGSLAEGEIIIRSKNITDNSKTIIVHLNESVKIECTRPSNNTRTSIRIGPGQAFYATGQVIGNIREAHCNISESKWNETLQRVSEKLKKYFPDKNITFRPSSGGDLEITTHSFNCGGEFFYCNTSSLFNRTYMATSTDMANSTETNSTRIITIHCRIKQIINMWQEVGRAMYAPPIAGNITCISNITGLLLTRDGGNNTEDTETFRPEGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYDDIWDNMTWMQWEREISNYTNIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALAWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 169 - DNA, 1509 bp, Artificial Sequence; identical to SEQ ID NO: 145
  Description of Artificial Sequence: Synthetic polynucleotide

SEQ ID NO: 170 - DNA, 1509 bp, Artificial Sequence; identical to SEQ ID NO: 146
  Description of Artificial Sequence: Synthetic polynucleotide

SEQ ID NO: 171 - DNA, 1509 bp, Artificial Sequence; identical to SEQ ID NO: 147
  Description of Artificial Sequence: Synthetic polynucleotide

SEQ ID NO: 172 - DNA, 1542 bp, Artificial Sequence; identical to SEQ ID NO: 148
  Description of Artificial Sequence: Synthetic polynucleotide

SEQ ID NO: 173 - DNA, 1514 bp, Artificial Sequence; identical to SEQ ID NO: 149
  Description of Artificial Sequence: Synthetic polynucleotide

SEQ ID NO: 174 - DNA, 1544 bp, Artificial Sequence
  Description of Artificial Sequence: Synthetic polynucleotide
ggtcgacaagaagccaccatgcgcgtgatgggccggcagcgcaactacccgcagtggtggatctggtcgatgctgggcctctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgacgccctgcgtgaagctgaccccgctgtgcgtgaccctgaactgcacggacgccaacgacaccgcgtcgaacagctccatcatcaaggggatgaacaactccatcgtgggggagatgaagaactgctccttcaacatcacgacggagctgcgcgacaagcgcgagaagaagaacgccctgttctacaagctggacatcgtgcagctggacggcaactcctcggagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggccaactcgacggacatggcgaactccgcggagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggaggcaactccagcacggagacggagaccttcaggccagggggaggcaacatgaaggacaactggcgctccgagctgtacaagtacaaggtggtggaggtgaagcccctgggcgtggcacccaccaacgcccgcgagcgcgtggtggagcgcgagaaggagtagtaaggtcaccgggacctgaattcggatcc

SEQ ID NO: 175 - protein, 486 aa, Artificial Sequence; identical to SEQ ID NO: 50
  Description of Artificial Sequence: Synthetic polypeptide

SEQ ID NO: 176 - protein, 486 aa, Artificial Sequence; identical to SEQ ID NO: 51
  Description of Artificial Sequence: Synthetic polypeptide

SEQ ID NO: 177 - protein, 486 aa, Artificial Sequence; identical to SEQ ID NO: 52
  Description of Artificial Sequence: Synthetic polypeptide

SEQ ID NO: 178 - protein, 497 aa, Artificial Sequence; identical to SEQ ID NO: 154
  Description of Artificial Sequence: Synthetic polypeptide

SEQ ID NO: 179 - protein, 489 aa, Artificial Sequence; identical to SEQ ID NO: 155
  Description of Artificial Sequence: Synthetic polypeptide

SEQ ID NO: 180 - protein, 498 aa, Artificial Sequence
  Description of Artificial Sequence: Synthetic polypeptide
MRVMGRQRNYPQWWIWSMLGLWMLMICNGVPVWKEAKTTLFCASDAKAYEKEVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQAFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDGGNSSTETETFRPGGGNMKDNWRSELYKYKVVEVKPLGVAPTNARERVVEREKE

SEQ ID NO: 181 - DNA, 2131 bp, Artificial Sequence; identical to SEQ ID NO: 25
  Description of Artificial Sequence: Synthetic polynucleotide

SEQ ID NO: 182 - DNA, 2131 bp, Artificial Sequence; identical to SEQ ID NO: 26
  Description of Artificial Sequence: Synthetic polynucleotide

SEQ ID NO: 183 - DNA, 2125 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgccaccgcgtccaacaactccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacgtccatccggatcggccctggccaggccttctacgccaccggccaggtgatcggcgacatccgcaaggcgtactgcaacatctcggagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggacccgaattcggtcaccggatcc

SEQ ID NO: 184 - DNA, 2164 bp, Artificial Sequence
  Description of Artificial Sequence: Synthetic polynucleotide
gtcgacaagaagccaccatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgacgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgcgaagaccatcatcgtgcacctgaacgagtccgtgaagatcgagtgcacccgcccgaacaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcatcatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacacgagggacggaggcaagaacaacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagggtcctgaattcggtaaccggatcc

SEQ ID NO: 185 - DNA, 2129 bp, Artificial Sequence
  Description of Artificial Sequence: Synthetic polynucleotide
gtcgacaagaaatgcgcgtgatgggcatccagcgcaactacccgcagtggtggatctggtcgatgctgggcttctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaccaacgccaccgcgtccaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaccggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacgaacaacgacaagaccatcatcgtgcacctgaacgagtccgtgaagatcgagtgcacccgcccgagcaacaagacgcgcacctccatccggatcggccctggccaggccttctacgccaccggccaggtgatcggcgacatccgcgaggcgtactgcaacatcagcgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgacatggccaactccaccgagaccaactccacgcgcaacatcacgatccactgccgcatcaagcagatcatcaacatgtggcaggaggtgggccgcgccatgtacgcaccgcccatcgccggcaacatcacctgcatctccaacatcaccggcctcctgctgacccgcgacggcggcaagaacgacacggagaccttcaggccaggcggaggcaacatgaaggacaactggcgctccgagctgtacaagtacaaggtggtggaggtgaagcccctgggcgtggcacccaccaacgcccgcaggcgcgtcgtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgaagctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacggcgacatctgggacaacatgacctggatgcagtgggagcgcgagatctccaactacaccgagatcatctacgagctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcgcatcatcttcgccgtgctgtcgctggtgaaccgcgtgcgccagggctgatgagaggtcccggtaaccggatcc

SEQ ID NO: 186 - DNA, 2168 bp, Artificial Sequence
  Description of Artificial Sequence: Synthetic polynucleotide
ggtcgacaagaagccaccatgcgcgtgatgggccggcagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgacgccctgcgtgaagctgaccccgctgtgcgtgaccctgaactgcacggacgccaacgacaccgcgtcgaacagctccatcatcaaggggatgaacaactccatcgtgggggagatgaagaactgctccttcaacatcacgacggagctgcgcgacaagcgcgagaagaagaacgccctgttctacaagctggacatcgtgcagctggacggcaactcctcggagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggccaactcgacggacatggcgaactccgcggagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggaggcaactccagcacggagacggagaccttcaggccagggggaggcaacatgaaggacaactggcgctccgagctgtacaagtacaaggtggtggaggtgaagcccctgggcgtggcacccaccaacgcccgcaggcgcgtggtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgcggctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagggggagatctccaactacaccaacatcatctacgacctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcggatcatcttcgccgtgctgtcgctggtgaaccgcgtgcgccagggctgatgaggtcaccgggacctgaattcggatcc

SEQ ID NO: 187 - protein, 694 aa, Artificial Sequence; identical to SEQ ID NO: 31
  Description of Artificial Sequence: Synthetic polypeptide

SEQ ID NO: 188 - protein, 694 aa, Artificial Sequence; identical to SEQ ID NO: 32
  Description of Artificial Sequence: Synthetic polypeptide

SEQ ID NO: 189 - protein, 694 aa, Artificial Sequence; identical to SEQ ID NO: 33
  Description of Artificial Sequence: Synthetic polypeptide

SEQ ID NO: 190 - protein, 705 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 191 - protein, 697 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQAFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDGGKNDTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQG

SEQ ID NO: 192 - protein, 706 aa, Artificial Sequence
  Description of Artificial Sequence: Synthetic polypeptide
MRVMGRQRNYPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQAFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDGGNSSTETETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYDDIWDNMTWMQWEGEISNYTNIIYDLLEESQNQQEKNEQDLLALDRWNSLWNWFNITNWLWYIKIFIMIVGGLIGLRIIFAVLSLVNRVRQG

SEQ ID NO: 193 - DNA, 2613 bp, Artificial Sequence
  Description of Artificial Sequence: Synthetic polynucleotide
gtcgtcgacaagaagccaccatgcgcgtgatgggccggcagcgcaactacccgcagtggtggatctggtcgatgctgggcctctggatgctcatgatctgcaacggcatgtgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgacgccctgcgtgaagctgaccccgctgtgcgtgaccctgaactgcacggacgccaacgacaccgcgtcgaacagctccatcatcaaggggatgaacaactccatcgtgggggagatgaagaactgctccttcaacatcacgacggagctgcgcgacaagcgcgagaagaagaacgccctgttctacaagctggacatcgtgcagctggacggcaactcctcggagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggccaactcgacggacatggcgaactccgcggagaccaactccacgcgcaccatcacgctccactgccgcatcaagcagatcatcaacatgtggcaggaggtgggccgcgccatgtacgcaccgcccatcgccggcaacatcacctgcatctccaacatcaccggcctcctgctgacccgcgacggaggcaactccagcacggagacggagaccttcaggccagggggaggcaacatgaaggacaactggcgctccgagctgtacaagtacaaggtggtggaggtgaagcccctgggcgtggcacccaccaacgcccgcaggcgcgtggtggagcgcgagaagcgcgccgtgggcatgggcgccgtgttcctgggcttcctgggcgctgcgggctccaccatgggtgccgcgtccatcaccctgaccgtgcaggcccgccagctgctctccggcatcgtgcagcagcagtccaacctcctgaaggccatcgaggcccagcagcacatgctgcggctgaccgtgtggggcatcaagcagctgcaggccagggtgctcgcgctcgagcgctacctgaaggaccagcagctgctcggcatgtggggctgctccggcaagctgatctgcaccaccaacgtgtactggaactcgtcctggtccaacaagacctacgacgacatctgggacaacatgacctggatgcagtgggagggggagatctccaactacaccaacatcatctacgacctcctcgaggagtcccagaaccagcaggagaagaacgagcaggatctgctcgcgctggaccgctggaactccctgtggaactggttcaacatcaccaactggctgtggtacatcaagatcttcatcatgatcgtgggcggcctgatcggcctgcggatcatcttcgccgtgctgtcgctggtgaaccgcgtgcgccagggctactccccgctgtccctgcaaacgctgatcccctccccccggggcccggacaggcccggtggcatcgaggaggagggcggcgagcaggaccgcaagcgctccacgcgcctggtgtccggcttcctggccctggtgtgggacgacctgcgctccctgtgcctgttcctctaccaccgcctgcgcgacttcatcctgatcgcggcccgcgctggcgagctgctgggccggtcctcgctgaagggcctgcgccgcggctgggaggccctgaagtacctgggcagcctggtgcagtactggggcctggagctgaagcgctccgccatctccctgctggacaccctggccatcgccgtgggcgagggcaccgaccgcatcctggagttcgtgctgggcatctgccgcgccatccgcaacatccccacccgcatccgccagggcttcgagaccgccctcctgtgatgaggtcaccgggacc

SEQ ID NO: 194 - protein, 858 aa, Artificial Sequence
  Description of Artificial Sequence: Synthetic polypeptide
MRVMGRQRNYPQWWIWSMLGLWMLMICNGMWVTVYYGVPVWKEAKTTLFCASDAKAYEKEVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQAFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDGGNSSTETETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLRLTVWGIKQLQARVLALERYLKDQQLLGMWGCSGKLICTTNVYWNSSWSNKTYDDIWDNMTWMQWEGEISNYTNIIYDLLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRKRSTRLVSGFLALVWDDLRSLCLFLYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 195 - DNA, 1947 bp, Artificial Sequence
  Description of Artificial Sequence: Synthetic polynucleotide
atgcccatgggcagcctgcagcccctggccaccctgtacctgctgggcatgctggtggctagcgtgctggccgccgagaacctgtgggtgaccgtctactatggcgtgcccgtctggaaggaagccaaaaccacactgttctgcgctagcgacgctaaggcatacgagaaagaagtgcacaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgatcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccaggccttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcgggccatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggattgatga

SEQ ID NO: 196 - DNA, 1977 bp, Artificial Sequence
  Description of Artificial Sequence: Synthetic polynucleotide
atggggagcctgcagcctctggcaaccctgtatctgctgggaatgctggtcgcaagtgtcctggccgccgaaaacctgtgggtcaccgtgtattatggagtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaacgccaccgcgtccaactcctctatcatcgaggggatgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctcggagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacgtccaccgacatggccaactccaccgagaccaactccacgcgcatcatcacgatccggtgccgcatcaagcagatcatcaacatgtggcaggaggtgggccgcgccatgtacgcaccgcccatcgccggcaacatcacctgcatctccaacatcaccggcctcctgctgacccgcgacggcggcaagaacaacacggagaccttcgagacgttcaggccaggcggaggcaacatgaaggataactggaggtccgagctgtacaagtataaagtggtcaagatcgaacctctgggagtggcaccaaccagatgcaagcgaagagtggtcggacgaaggaggaggaggcgagcagtcggaattggggccgtgttcctgggatttctgggcgccgctgggagtacaatgggagcagcctcaatgactctgaccgtgcaggccaggaatctgctgagcggcatcgtccagcagcagtccaacctgctgcgcgctcctgaagcacagcagcacctgctgaagctgaccgtgtggggcatcaaacagctgcaggctagggtgctggcagtcgagcggtacctgagagaccagcagctgctgggaatctggggctgctctgggaagctgatttgttgcacaaatgtgccttggaactctagttggtcaaatcgcaacctgagcgagatctgggacaatatgacttggctgcagtgggataaagaaattagtaactacacccagatcatctacggcctgctggaagagtcacagaatcagcaggagaagaacgaacaggacctgctggcactggattga

SEQ ID NO: 197 - DNA, 1944 bp, Artificial Sequence
  Description of Artificial Sequence: Synthetic polynucleotide
atggggagcctgcagcctctggcaaccctgtatctgctgggaatgctggtcgcaagtgtcctggccgccgaaaacctgtgggtcaccgtgtattatggagtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcatcgacgccaacgcgaccgcgtccaacgcgacggcatccaactcgtccatcatcgaggggatgaagaactgctccttcaacatcacgacggagctgcgcgacaagatcgagaagaagaacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacgaacagcgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcacgatcacgctccactgccgcatcaagcagatcatcaacatgtggcaggaggtgggccgcgccatgtacgcaccgcccatcgccggcaacatcacctgcatctccaacatcaccggcctcctgctgacccgcgacggcggcaacaacaacaccacggagaccttcaggccagggggaggcaacatgaaggataactggaggtccgagctgtacaagtataaagtggtcaagatcgaacctctgggagtggcaccaaccagatgcaagcgaagagtggtcggacgaaggaggaggaggcgagcagtcggaattggggccgtgttcctgggatttctgggcgccgctgggagtacaatgggagcagcctcaatgactctgaccgtgcaggccaggaatctgctgagcggcatcgtccagcagcagtccaacctgctgcgcgctcctgaagcacagcagcacctgctgaagctgaccgtgtggggcatcaaacagctgcaggctagggtgctggcagtcgagcggtacctgagagaccagcagctgctgggaatctggggctgctctgggaagctgatttgttgcacaaatgtgccttggaactctagttggtcaaatcgcaacctgagcgagatctgggacaatatgacttggctgcagtgggataaagaaattagtaactacacccagatcatctacggcctgctggaagagtcacagaatcagcaggagaagaacgaacaggacctgctggcactggattga

SEQ ID NO: 198 - DNA, 1989 bp, Artificial Sequence
  Description of Artificial Sequence: Synthetic polynucleotide
atggggagcctgcagcctctggcaaccctgtatctgctgggaatgctggtcgcaagtgtcctggccgccgaaaacctgtgggtcaccgtgtattatggagtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctggagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcacggacgccaacgccaccgcgtcgaacaccaacgcgaccgcaagcaacatcaacgcgacggcgtcgaagtcctccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtcatcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacagcaagaccatcatcgtgcacctgaacgagtccgtgaagatcgagtgcacccgcccgagcaacaacacgcgcacctccatccggatcggccctggccaggccttctacgccaccggccaagtgatcggcgacatccgcgaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctgcactgccgcatcaagcagatcatcaacatgtggcaggaggtgggccgcgccatgtacgcaccgcccatcgccggcaacatcacctgcatctccaacatcaccggcctcctgctgacccgcgacggcggcgagaacacccgggacggaggcaacaacaacacggagaccttcaggccagagggaggcaacatgaaggataactggaggtccgagctgtacaagtataaagtggtcaagatcgaacctctgggagtggcaccaaccagatgcaagcgaagagtggtcggacgaaggaggaggaggcgagcagtcggaattggggccgtgttcctgggatttctgggcgccgctgggagtacaatgggagcagcctcaatgactctgaccgtgcaggccaggaatctgctgagcggcatcgtccagcagcagtccaacctgctgcgcgctcctgaagcacagcagcacctgctgaagctgaccgtgtggggcatcaaacagctgcaggctagggtgctggcagtcgagcggtacctgagagaccagcagctgctgggaatctggggctgctctgggaagctgatttgttgcacaaatgtgccttggaactctagttggtcaaatcgcaacctgagcgagatctgggacaatatgacttggctgcagtgggataaagaaattagtaactacacccagatcatctacggcctgctggaagagtcacagaatcagcaggagaagaacgaacaggacctgctggcactggattga

SEQ ID NO: 199 - DNA, 1947 bp, Artificial Sequence
  Description of Artificial Sequence: Synthetic polynucleotide
atgcccatgggcagcctgcagcccctggccaccctgtacctgctgggcatgctggtggctagcgtgctggccgccgagaacctgtgggtgaccgtctactatggcgtgcccgtctggaaggaagccaaaaccacactgttctgcgctagcgacgctaaggcatacgagaaagaagtgcacaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgtgcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccaggccttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcggtgcatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggattgatga

SEQ ID NO: 200 - DNA, 1977 bp, Artificial Sequence
  Description of Artificial Sequence: Synthetic polynucleotide
atggggagcctgcagcctctggcaaccctgtatctgctgggaatgctggtcgcaagtgtcctggccgccgaaaacctgtgggtcaccgtgtattatggagtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggtggaccagatgcacgaggacgtgatctccctgtgggaccagtccctgaagccctgcgtgaagctgaccccgctgtgcgtgaccctgaactgcaccaacgcgaacgccaccgcgtccaactcctctatcatcgaggggatgaactcctccatcatcgagggcatgaagaactgctccttcaacatcacgacggagctgcgcgacaagcgcgagaagaagaacgccctgttctacaagctggacatcgtgcagctggacggcaactcctcgcagtacaggctgatcaactgcaacacctccgtctgcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtccgagaacatcacggacaacgggaagaccatcatcgtgcacctgaacgagtccgtgaagatcgagtgcacccgcccgagcaacaacacgcgcacctccatccggatcggccctggccaggccttctacgccaccggccaggtgatcggcgacatccgcgaggcgcactgcaacatctcggagtccaagtggaacgagaccctgcagcgcgtgtccgagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccacgtccaccgacatggccaactccaccgagaccaactccacgcgcatcatcacgatccggtgccgcatcaagcagatcatcaacatgtggcaggaggtgggccgctgcatgtacgcaccgcccatcgccggcaacatcacctgcatctccaacatcaccggcctcctgctgacccgcgacggcggcaagaacaacacggagaccttcgagacgttcaggccaggcggaggcaacatgaaggataactggaggtccgagctgtacaagtataaagtggtcaagatcgaacctctgggagtggcaccaaccagatgcaagcgaagagtggtcggacgaaggaggaggaggcgagcagtcggaattggggccgtgttcctgggatttctgggcgccgctgggagtacaatgggagcagcctcaatgactctgaccgtgcaggccaggaatctgctgagcggcatcgtccagcagcagtccaacctgctgcgcgctcctgaagcacagcagcacctgctgaagctgaccgtgtggggcatcaaacagctgcaggctagggtgctggcagtcgagcggtacctgagagaccagcagctgctgggaatctggggctgctctgggaagctgatttgttgcacaaatgtgccttggaactctagttggtcaaatcgcaacctgagcgagatctgggacaatatgacttggctgcagtgggataaagaaattagtaactacacccagatcatctacggcctgctggaagagtcacagaatcagcaggagaagaacgaacaggacctgctggcactggattga

SEQ ID NO: 201 - DNA, 1944 bp, Artificial Sequence
  Description of Artificial Sequence: Synthetic polynucleotide
atggggagcctgcagcctctggcaaccctgtatctgctgggaatgctggtcgcaagtgtcctggccgccgaaaacctgtgggtcaccgtgtattatggagtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctgaagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcatcgacgccaacgcgaccgcgtccaacgcgacggcatccaactcgtccatcatcgaggggatgaagaactgctccttcaacatcacgacggagctgcgcgacaagatcgagaagaagaacgccctgttctacaagctggacatcgtgcagctggacggcaactcctcgcagtacaggctgatcaactgcaacacctccgtctgcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacgaacagcgcgaagaccatcatcgtgcacctgaacgagtccgtgaagatcgagtgcacccgcccgagcaacaacacgcgcacctccatccggatcggccctggccaggccttctacgccaccggccaggtgatcggcgacatccgcaaggcgcactgcaacatctccgagtccaagtggaacgagaccctgcagcgcgtgtccaagaagctgaaggagtacttcccccacaagaacatcaccttccagccgtcgtccggcggcgacctcgagatcaccacgcactccttcaactgcggtggcgagttcttctactgcaacacgtcgtcgctgttcaaccgcacctacatggccaactccaccgagaccaactccacgcgcacgatcacgctccactgccgcatcaagcagatcatcaacatgtggcaggaggtgggccgctgcatgtacgcaccgcccatcgccggcaacatcacctgcatctccaacatcaccggcctcctgctgacccgcgacggcggcaacaacaacaccacggagaccttcaggccagggggaggcaacatgaaggataactggaggtccgagctgtacaagtataaagtggtcaagatcgaacctctgggagtggcaccaaccagatgcaagcgaagagtggtcggacgaaggaggaggaggcgagcagtcggaattggggccgtgttcctgggatttctgggcgccgctgggagtacaatgggagcagcctcaatgactctgaccgtgcaggccaggaatctgctgagcggcatcgtccagcagcagtccaacctgctgcgcgctcctgaagcacagcagcacctgctgaagctgaccgtgtggggcatcaaacagctgcaggctagggtgctggcagtcgagcggtacctgagagaccagcagctgctgggaatctggggctgctctgggaagctgatttgttgcacaaatgtgccttggaactctagttggtcaaatcgcaacctgagcgagatctgggacaatatgacttggctgcagtgggataaagaaattagtaactacacccagatcatctacggcctgctggaagagtcacagaatcagcaggagaagaacgaacaggacctgctggcactggattga

SEQ ID NO: 202 - DNA, 1989 bp, Artificial Sequence
  Description of Artificial Sequence: Synthetic polynucleotide
atggggagcctgcagcctctggcaaccctgtatctgctgggaatgctggtcgcaagtgtcctggccgccgaaaacctgtgggtcaccgtgtattatggagtgccggtgtggaaggaggccaagacgaccctgttctgcgcgtcggacgccaaggcctacgagaaggaggtgcacaacgtgtgggcgacccacgcctgcgtgcccacggaccccaacccgcaggagatggtgctggagaacgtgaccgagaacttcaacatgtggaagaacgacatggcggaccagatgcacgaggacgtgatctccctgtgggaccagtccctgaagccctgcgtgaagctgaccccgctgtgcgtgaccctgaactgcacggacgccaacgccaccgcgtcgaacaccaacgcgaccgcaagcaacatcaacgcgacggcgtcgaagtcctccatcatcgaggagatgaagaactgctccttcaacatcacgacggagctgcgcgacaagcgcgagaagaagtacgccctgttctacaagctggacatcgtgcagctggacggcaactcctcgcagtacaggctgatcaactgcaacacctccgtctgcacgcaggcgtgccccaaggtgtccttcgaccccatccccatccactactgcgcccccgccggctacgccatcctgaagtgcaacaacaagaccttcaacggcaccggcccgtgcaacaacgtgtccaccgtgcagtgcacgcacgggatcaagcccgtggtgtccacgcagctgctcctgaacgggtcgctggccgagggcgagatcatcatccggtcggagaacatcacggacaacagcaagaccatcatcgtgcacctgaacgagtccgtgaagatcgagtgcacccgcccgagcaacaacacgcgcacctccatccggatcggccctggccaggccttctacgccaccggccaagtgatcggcgacatccgcgaggcgcactgcaacatctccgagtccaagtggaacgagaccctgcagcgcgtgtccaagaagctgaaggagtacttccccgacaagaacatcaccttccagccgtcgtccggcggcgaccccgagatcaccacgcactccttcaactgcggtggcgagttcttctactgcaacacgtcgtccctgttcaaccgcacctacatggcgaactccaccgagaccaactccacgcgcaccatcacgctgcactgccgcatcaagcagatcatcaacatgtggcaggaggtgggccgctgcatgtacgcaccgcccatcgccggcaacatcacctgcatctccaacatcaccggcctcctgctgacccgcgacggcggcgagaacacccgggacggaggcaacaacaacacggagaccttcaggccagagggaggcaacatgaaggataactggaggtccgagctgtacaagtataaagtggtcaagatcgaacctctgggagtggcaccaaccagatgcaagcgaagagtggtcggacgaaggaggaggaggcgagcagtcggaattggggccgtgttcctgggatttctgggcgccgctgggagtacaatgggagcagcctcaatgactctgaccgtgcaggccaggaatctgctgagcggcatcgtccagcagcagtccaacctgctgcgcgctcctgaagcacagcagcacctgctgaagctgaccgtgtggggcatcaaacagctgcaggctagggtgctggcagtcgagcggtacctgagagaccagcagctgctgggaatctggggctgctctgggaagctgatttgttgcacaaatgtgccttggaactctagttggtcaaatcgcaacctgagcgagatctgggacaatatgacttggctgcagtgggataaagaaattagtaactacacccagatcatctacggcctgctggaagagtcacagaatcagcaggagaagaacgaacaggacctgctggcactggattga

SEQ ID NO: 203 - DNA, 1944 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaagaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 204 - DNA, 1944 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaagaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 205 - DNA, 1944 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacggcaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 206 - DNA, 1944 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacggcaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 207 - DNA, 1983 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaacgccaccgcctccaactcctccatcatcgagggcatgaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacggcaagaccatcatcgtgcacctgaacgagtccgtgaagatcgagtgcacccgcccctccaacaacacccgcacctccatccgcatcggccccggccagtggttctacgccaccggccaggtgatcggcgacatccgcgaggcccactgcaacatctccgagtccaagtggaacgagaccctgcagcgcgtgtccgagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccacctccaccgacatggccaactccaccgagaccaactccacccgcatcatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttcgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 208 - DNA, 1983 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaacgccaccgcctccaactcctccatcatcgagggcatgaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacggcaagaccatcatcgtgcacctgaacgagtccgtgaagatcgagtgcacccgcccctccaacaacacccgcacctccatccgcatcggccccggccagtggttctacgccaccggccaggtgatcggcgacatccgcgaggcccactgcaacatctccgagtccaagtggaacgagaccctgcagcgcgtgtccgagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccacctccaccgacatggccaactccaccgagaccaactccacccgcatcatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttcgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 209 - DNA, 1950 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggccgaccagatgcacgaggacgtgatctccctgtgggaccagtccctgaagccctgcgtgaagctgacccccctgtgcgtgaccctgaactgcatcgacgccaacgccaccgcctccaacgccaccgcctccaactcctccatcatcgagggcatgaagaactgctccttcaacatcaccaccgagctgcgcgacaagatcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccaactccgccaagaccatcatcgtgcacctgaacgagtccgtgaagatcgagtgcacccgcccctccaacaacacccgcacctccatccgcatcggccccggccagtggttctacgccaccggccaggtgatcggcgacatccgcaaggcccactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgagaccaactccacccgcaccatcaccctgcactgccgcatcaagcagatcatcaacatgtggcaggaggtgggccgcgccatgtacgccccccccatcgccggcaacatcacctgcatctccaacatcaccggcctgctgctgacccgcgacggcggcaacaacaacaccaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 210 - DNA, 1950 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggccgaccagatgcacgaggacgtgatctccctgtgggaccagtccctgaagccctgcgtgaagctgacccccctgtgcgtgaccctgaactgcatcgacgccaacgccaccgcctccaacgccaccgcctccaactcctccatcatcgagggcatgaagaactgctccttcaacatcaccaccgagctgcgcgacaagatcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccaactccgccaagaccatcatcgtgcacctgaacgagtccgtgaagatcgagtgcacccgcccctccaacaacacccgcacctccatccgcatcggccccggccagtggttctacgccaccggccaggtgatcggcgacatccgcaaggcccactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgagaccaactccacccgcaccatcaccctgcactgccgcatcaagcagatcatcaacatgtggcaggaggtgggccgcgccatgtacgccccccccatcgccggcaacatcacctgcatctccaacatcaccggcctgctgctgacccgcgacggcggcaacaacaacaccaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 211 - DNA, 1995 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctggagaacgtgaccgagaacttcaacatgtggaagaacgacatggccgaccagatgcacgaggacgtgatctccctgtgggaccagtccctgaagccctgcgtgaagctgacccccctgtgcgtgaccctgaactgcaccgacgccaacgccaccgcctccaacaccaacgccaccgcctccaacatcaacgccaccgcctccaagtcctccatcatcgaggagatgaagaactgctccttcaacatcaccaccgagctgcgcgacaagcgcgagaagaagtacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaactccaagaccatcatcgtgcacctgaacgagtccgtgaagatcgagtgcacccgcccctccaacaacacccgcacctccatccgcatcggccccggccagtggttctacgccaccggccaggtgatcggcgacatccgcgaggcccactgcaacatctccgagtccaagtggaacgagaccctgcagcgcgtgtccaagaagctgaaggagtacttccccgacaagaacatcaccttccagccctcctccggcggcgaccccgagatcaccacccactccttcaactgcggcggcgagttcttctactgcaacacctcctccctgttcaaccgcacctacatggccaactccaccgagaccaactccacccgcaccatcaccctgcactgccgcatcaagcagatcatcaacatgtggcaggaggtgggccgcgccatgtacgccccccccatcgccggcaacatcacctgcatctccaacatcaccggcctgctgctgacccgcgacggcggcgagaacacccgcgacggcggcaacaacaacaccgagaccttccgccccgagggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 212 - DNA, 1995 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctggagaacgtgaccgagaacttcaacatgtggaagaacgacatggccgaccagatgcacgaggacgtgatctccctgtgggaccagtccctgaagccctgcgtgaagctgacccccctgtgcgtgaccctgaactgcaccgacgccaacgccaccgcctccaacaccaacgccaccgcctccaacatcaacgccaccgcctccaagtcctccatcatcgaggagatgaagaactgctccttcaacatcaccaccgagctgcgcgacaagcgcgagaagaagtacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaactccaagaccatcatcgtgcacctgaacgagtccgtgaagatcgagtgcacccgcccctccaacaacacccgcacctccatccgcatcggccccggccagtggttctacgccaccggccaggtgatcggcgacatccgcgaggcccactgcaacatctccgagtccaagtggaacgagaccctgcagcgcgtgtccaagaagctgaaggagtacttccccgacaagaacatcaccttccagccctcctccggcggcgaccccgagatcaccacccactccttcaactgcggcggcgagttcttctactgcaacacctcctccctgttcaaccgcacctacatggccaactccaccgagaccaactccacccgcaccatcaccctgcactgccgcatcaagcagatcatcaacatgtggcaggaggtgggccgcgccatgtacgccccccccatcgccggcaacatcacctgcatctccaacatcaccggcctgctgctgacccgcgacggcggcgagaacacccgcgacggcggcaacaacaacaccgagaccttccgccccgagggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 213 - DNA, 1980 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaccccctgcgtgaagctgacccccctgtgcgtgaccctgaactgcaccgacgccaacgacaccgcctccaactcctccatcatcaagggcatgaacaactccatcgtgggcgagatgaagaactgctccttcaacatcaccaccgagctgcgcgacaagcgcgagaagaagaacgccctgttctacaagctggacatcgtgcagctggacggcaactcctccgagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacgccaagaccatcatcgtgcacctgaacgagtccgtgaagatcgagtgcacccgcccctccaacaacacccgcacctccatccgcatcggccccggccagtggttctacgccaccggccaggtgatcggcgacatccgcaaggcccactgcaacatctccgagtccaagtggaacgagaccctgcagcgcgtgtccaagaagctgaaggagtacttccccgacaagaacatcaccttccagccctcctccggcggcgaccccgagatcaccacccactccttcaactgcggcggcgagttcttctactgcaacacctcctccctgttcaaccgcacctacatggccaactccaccgacatggccaactccgccgagaccaactccacccgcaccatcaccctgcactgccgcatcaagcagatcatcaacatgtggcaggaggtgggccgcgccatgtacgccccccccatcgccggcaacatcacctgcatctccaacatcaccggcctgctgctgacccgcgacggcggcaactcctccaccgagaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 214 - DNA, 1980 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaccccctgcgtgaagctgacccccctgtgcgtgaccctgaactgcaccgacgccaacgacaccgcctccaactcctccatcatcaagggcatgaacaactccatcgtgggcgagatgaagaactgctccttcaacatcaccaccgagctgcgcgacaagcgcgagaagaagaacgccctgttctacaagctggacatcgtgcagctggacggcaactcctccgagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacgccaagaccatcatcgtgcacctgaacgagtccgtgaagatcgagtgcacccgcccctccaacaacacccgcacctccatccgcatcggccccggccagtggttctacgccaccggccaggtgatcggcgacatccgcaaggcccactgcaacatctccgagtccaagtggaacgagaccctgcagcgcgtgtccaagaagctgaaggagtacttccccgacaagaacatcaccttccagccctcctccggcggcgaccccgagatcaccacccactccttcaactgcggcggcgagttcttctactgcaacacctcctccctgttcaaccgcacctacatggccaactccaccgacatggccaactccgccgagaccaactccacccgcaccatcaccctgcactgccgcatcaagcagatcatcaacatgtggcaggaggtgggccgcgccatgtacgccccccccatcgccggcaacatcacctgcatctccaacatcaccggcctgctgctgacccgcgacggcggcaactcctccaccgagaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 215 - DNA, 1944 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaacaactccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgccccaacaacaagacccgcacctccatccgcatcggccccggccagtggttctacgccaccggccaggtgatcggcgacatccgcaaggcctactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccctgcactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 216 - DNA, 1944 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaacaactccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgccccaacaacaagacccgcacctccatccgcatcggccccggccagtggttctacgccaccggccaggtgatcggcgacatccgcaaggcctactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccctgcactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 217 - DNA, 1953 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgacaagaccatcatcgtgcacctgaacgagtccgtgaagatcgagtgcacccgcccctccaacaagacccgcacctccatccgcatcggccccggccagtggttctacgccaccggccaggtgatcggcgacatccgcgaggcctactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaacatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacgacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 218 - DNA, 1953 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgacaagaccatcatcgtgcacctgaacgagtccgtgaagatcgagtgcacccgcccctccaacaagacccgcacctccatccgcatcggccccggccagtggttctacgccaccggccaggtgatcggcgacatccgcgaggcctactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaacatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacgacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 219 - DNA, 1977 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcatcatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 220 - DNA, 1977 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcatcatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 221 - DNA, 1944 bp, Artificial Sequence
  Description of Artificial Sequence: Synthetic polynucleotide
atgcccatgggcagcctgcagcccctggccaccctgtacctgctgggcatgctggtggctagcgtgctggccgccgagaacctgtgggtgaccgtctactatggcgtgcccgtctggaaggaagccaaaaccacactgttctgcgctagcgacgctaaggcatacgagaaaaaagtgcacaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgatcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccagtggttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcgggccatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggattga

SEQ ID NO: 222 - DNA, 1938 bp, Artificial Sequence
  Description of Artificial Sequence: Synthetic polynucleotide
atgggcagcctgcagcccctggccaccctgtacctgctgggcatgctggtggctagcgtgctggccgccgagaacctgtgggtgaccgtctactatggcgtgcccgtctggaaggaagccaaaaccacactgttctgcgctagcgacgctaaggcatacgagaaagaagtgagaaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgatcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccagtggttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcgggccatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggattga

SEQ ID NO: 223 - DNA, 1956 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgccccaacaacaagacccgcacctccatccgcatcggccccggccaggccttctacgccaccggccaggtgatcggcgacatccgcgaggcccactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 224 - DNA, 1956 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgtgcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgccccaacaacaagacccgcacctccatccgcatcggccccggccaggccttctacgccaccggccaggtgatcggcgacatccgcgaggcccactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccgctgccgcatcaagcagatcatcaacatgtggcaggaggtgggccgctgcatgtacgccccccccatcgccggcaacatcacctgcatctccaacatcaccggcctgctgctgacccgcgacggcggcaagaacaacaccgacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 225 - DNA, 1956 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcccactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 226 - DNA, 1956 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcccactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 227 - DNA, 1977 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcacaacgtgtgggccacccacgcctgcgtgcccaccgaccccaacccccaggagatggtgctgaagaacgtgaccgagaacttcaacatgtgggagaacgacatggtggaccagatgcacgaggacgtgatctccctgtgggaccagtccctgaagccctgcgtgaagctgacccccctgtgcgtgaccctgaactgcaccgacgccaccgcctccaacgccaccgcctccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacggcaagaccatcatcgtgcacctgaacgagtccgtgaagatcgagtgcacccgcccctccaacaacacccgcacctccatccgcatcggccccggccaggccttctacgccaccggccaggtgatcggcgacatccgcgaggcccactgcaacatctccgagaacaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttcgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 228 - DNA, 1977 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcacaacgtgtgggccacccacgcctgcgtgcccaccgaccccaacccccaggagatggtgctgaagaacgtgaccgagaacttcaacatgtgggagaacgacatggtggaccagatgcacgaggacgtgatctccctgtgggaccagtccctgaagccctgcgtgaagctgacccccctgtgcgtgaccctgaactgcaccgacgccaccgcctccaacgccaccgcctccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgtgcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacggcaagaccatcatcgtgcacctgaacgagtccgtgaagatcgagtgcacccgcccctccaacaacacccgcacctccatccgcatcggccccggccaggccttctacgccaccggccaggtgatcggcgacatccgcgaggcccactgcaacatctccgagaacaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccgctgccgcatcaagcagatcatcaacatgtggcaggaggtgggccgctgcatgtacgccccccccatcgccggcaacatcacctgcatctccaacatcaccggcctgctgctgacccgcgacggcggcaagaacaacaccgagaccttcgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 229 - DNA, 1974 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtgggagaacgacatggtggaccagatgcacgaggacgtgatctccctgtgggaccagtccctgaagccctgcgtgaagctgacccccctgtgcgtgaccctgaactgcaccgacgccaccgcctccaacgccaccgcctccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacggcaagaccatcatcgtgcacctgaacgagtccgtgaagatcgagtgcacccgcccctccaacaacacccgcacctccatccgcatcggccccggccagtggttctacgccaccggccaggtgatcggcgacatccgcgaggcccactgcaacatctccgagaacaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttcgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggac

SEQ ID NO: 230 - DNA, 1977 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtgggagaacgacatggtggaccagatgcacgaggacgtgatctccctgtgggaccagtccctgaagccctgcgtgaagctgacccccctgtgcgtgaccctgaactgcaccgacgccaccgcctccaacgccaccgcctccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccgacaacggcaagaccatcatcgtgcacctgaacgagtccgtgaagatcgagtgcacccgcccctccaacaacacccgcacctccatccgcatcggccccggccagtggttctacgccaccggccaggtgatcggcgacatccgcgaggcccactgcaacatctccgagaacaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttcgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 231 - DNA, 1944 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccgacgccaccgcctccaacgccaccgccatcaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgcccctccaacaacacccgcacctccatccgcatcggccccggccaggccttctacgccaccggccaggtgatcggcgacatccgcgaggcccactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgagaccaactccacccgcatcatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttcgagaccttccgccccgagggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 232 - DNA, 1944 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccgacgccaccgcctccaacgccaccgccatcaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgcccctccaacaacacccgcacctccatccgcatcggccccggccagtggttctacgccaccggccaggtgatcggcgacatccgcgaggcccactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgagaccaactccacccgcatcatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttcgagaccttccgccccgagggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 233 - DNA, 1944 bp, Artificial Sequence
  Description of Artificial Sequence: Synthetic polynucleotide
atgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaaggaggtgcgcaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccgacgccaccgcctccaacgccaccgccatcaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgccaagaccatcatcgtgcacctgaacgagtccgtgaagatcgagtgcacccgcccctccaacaacacccgcacctccatccgcatcggccccggccagtggttctacgccaccggccaggtgatcggcgacatccgcgaggcccactgcaacatctccgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgagaccaactccacccgcatcatcaccatccgctgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttcgagaccttccgccccgagggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 234 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 235 - protein, 658 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 236 - protein, 647 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGNNNTTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 237 - protein, 662 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 238 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVCTQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRCMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 239 - protein, 658 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVCTQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRCMYAPPIAGNITCISNITGLLLTRDGGKNNTETFETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 240 - protein, 647 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVCTQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQAFYATGQVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRCMYAPPIAGNITCISNITGLLLTRDGGNNNTTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 241 - protein, 662 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVCTQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQAFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRCMYAPPIAGNITCISNITGLLLTRDGGENTRDGGNNNTETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 242 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 243 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 244 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 245 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITDNGKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 246 - protein, 660 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQWFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 247 - protein, 660 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLKPCVKLTPLCVTLNCTNANATASNSSIIEGMNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQWFYATGQVIGDIREAHCNISESKWNETLQRVSEKLKEYFPHKNITFQPSSGGDLEITTHSFNCGGEFFYCNTSSLFNRTYMATSTDMANSTETNSTRIITIRCRIKQIINMWQEVGRAMYAPPIAGNITCISNITGLLLTRDGGKNNTETFETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 248 - protein, 649 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQWFYATGQVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGNNNTTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 249 - protein, 649 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLKNVTENFNMWKNDMADQMHEDVISLWDQSLKPCVKLTPLCVTLNCIDANATASNATASNSSIIEGMKNCSFNITTELRDKIEKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNSAKTIIVHLNESVKIECTRPSNNTRTSIRIGPGQWFYATGQVIGDIRKAHCNISESKWNETLQRVSKKLKEYFPHKNITFQPSSGGDLEITTHSFNCGGEFFYCNTSSLFNRTYMANSTETNSTRTITLHCRIKQIINMWQEVGRAMYAPPIAGNITCISNITGLLLTRDGGNNNTTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 250 - protein, 664 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQWFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 251 - protein, 664 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLENVTENFNMWKNDMADQMHEDVISLWDQSLKPCVKLTPLCVTLNCTDANATASNTNATASNINATASKSSIIEEMKNCSFNITTELRDKREKKYALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNSKTIIVHLNESVKIECTRPSNNTRTSIRIGPGQWFYATGQVIGDIREAHCNISESKWNETLQRVSKKLKEYFPDKNITFQPSSGGDPEITTHSFNCGGEFFYCNTSSLFNRTYMANSTETNSTRTITLHCRIKQIINMWQEVGRAMYAPPIAGNITCISNITGLLLTRDGGENTRDGGNNNTETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 252 - protein, 659 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQWFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDGGNSSTETETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 253 - protein, 659 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLTPCVKLTPLCVTLNCTDANDTASNSSIIKGMNNSIVGEMKNCSFNITTELRDKREKKNALFYKLDIVQLDGNSSEYRLINCNTSVITQACPKVSFDPIPIHYCAPAGYAILKCNNKTFNGTGPCNNVSTVQCTHGIKPVVSTQLLLNGSLAEGEIIIRSENITDNAKTIIVHLNESVKIECTRPSNNTRTSIRIGPGQWFYATGQVIGDIRKAHCNISESKWNETLQRVSKKLKEYFPDKNITFQPSSGGDPEITTHSFNCGGEFFYCNTSSLFNRTYMANSTDMANSAETNSTRTITLHCRIKQIINMWQEVGRAMYAPPIAGNITCISNITGLLLTRDGGNSSTETETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 254 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQWFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 255 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLKPCVKLTPLCVTLNCTNATASNNSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQWFYATGQVIGDIRKAYCNISESKWNETLQRVSKKLKEYFPHKNITFQPSSGGDLEITTHSFNCGGEFFYCNTSSLFNRTYMANSTDMANSTETNSTRTITLHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 256 - protein, 650 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQWFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDGGKNDTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 257 - protein, 650 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLKPCVKLTPLCVTLNCTNATNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNDKTIIVHLNESVKIECTRPSNKTRTSIRIGPGQWFYATGQVIGDIREAYCNISESKWNETLQRVSKKLKEYFPHKNITFQPSSGGDLEITTHSFNCGGEFFYCNTSSLFNRTYMANSTDMANSTETNSTRNITIHCRIKQIINMWQEVGRAMYAPPIAGNITCISNITGLLLTRDGGKNDTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 258 - protein, 658 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQWFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 259 - protein, 658 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQWFYATGQVIGDIREAYCNISESKWNETLQRVSKKLKEYFPHKNITFQPSSGGDLEITTHSFNCGGEFFYCNTSSLFNRTYMANSTDMANSTETNSTRIITIHCRIKQIINMWQEVGRAMYAPPIAGNITCISNITGLLLTRDGGKNTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 260 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 261 - protein, 647 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 262 - protein, 651 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 263 - protein, 651 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVCTQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQAFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRCMYAPPIAGNITCISNITGLLLTRDGGKNNTDTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 264 - protein, 651 aa, Artificial Sequence
  Description of Artificial Sequence: Synthetic polypeptide
MGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQWFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 265 - protein, 651 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLKPCVKLTPLCVTLNCTNATTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNAKTIIVHLNESVKIECTRPNNKTRTSIRIGPGQWFYATGQVIGDIREAHCNISESKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTDTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 266 - protein, 658 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISENKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 267 - protein, 658 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLKNVTENFNMWENDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVCTQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQAFYATGQVIGDIREAHCNISENKWNETLQRVSKKLKEYFPHKNITFQPSSGGDLEITTHSFNCGGEFFYCNTSSLFNRTYMANSTDMANSTETNSTRTITIRCRIKQIINMWQEVGRCMYAPPIAGNITCISNITGLLLTRDGGKNNTETFETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 268 - protein, 658 aa, Artificial Sequence
  Description of Artificial Sequence: Synthetic polypeptide
MGSLQPLATLYLLGMLVASVLAAENLWVTVYYGVPVWKEAKTTLFCASDAKAYEKKVHNVWATHACVPTDPNPQEMVLKNVTENFNMWENDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQWFYATGQVIGDIREAHCNISENKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 269 - protein, 658 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVRNVWATHACVPTDPNPQEMVLKNVTENFNMWENDMVDQMHEDVISLWDQSLKPCVKLTPLCVTLNCTDATASNATASNATASNSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITDNGKTIIVHLNESVKIECTRPSNNTRTSIRIGPGQWFYATGQVIGDIREAHCNISENKWNETLQRVSKKLKEYFPHKNITFQPSSGGDLEITTHSFNCGGEFFYCNTSSLFNRTYMANSTDMANSTETNSTRTITIRCRIKQIINMWQEVGRAMYAPPIAGNITCISNITGLLLTRDGGKNNTETFETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 270 - protein, 647 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTDATASNATAINSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNNAKTIIVHLNESVKIECTRPSNNTRTSIRIGPGQAFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGKNNTETFETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 271 - protein, 647 aa, Artificial Sequence
  Description of Artificial Sequence: Synthetic polypeptide
MGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTDATASNATAINSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNNAKTIIVHLNESVKIECTRPSNNTRTSIRIGPGQWFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGKNNTETFETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 272 - protein, 647 aa, Artificial Sequence
  Description of Artificial Sequence: Synthetic polypeptide
MGSLQPLATLYLLGMLVASVLAAENLWVTVYYGVPVWKEAKTTLFCASDAKAYEKEVRNVWATHACVPTDPNPQEMVLKNVTENFNMWKNDMVDQMHEDVISLWDQSLKPCVKLTPLCVTLNCTDATASNATAINSSIIEGMKNCSFNITTELRDKREKKNALFYKLDIVQLDGNSSQYRLINCNTSVITQACPKVSFDPIPIHYCAPAGYAILKCNNKTFNGTGPCNNVSTVQCTHGIKPVVSTQLLLNGSLAEGEIIIRSENITNNAKTIIVHLNESVKIECTRPSNNTRTSIRIGPGQWFYATGQVIGDIREAHCNISESKWNETLQRVSKKLKEYFPHKNITFQPSSGGDLEITTHSFNCGGEFFYCNTSSLFNRTYMANSTETNSTRIITIRCRIKQIINMWQEVGRAMYAPPIAGNITCISNITGLLLTRDGGKNNTETFETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 273 - protein, 24 aa, Artificial Sequence
  Description of Artificial Sequence: Synthetic peptide
MPMGSLQPLATLYLLGMLVASVLA

SEQ ID NO: 274 - protein, 647 aa, Artificial Sequence; identical to SEQ ID NO: 260
  Description of Artificial Sequence: Synthetic polypeptide

SEQ ID NO: 275 - protein, 846 aa, Artificial Sequence
  Description of Artificial Sequence: Synthetic polypeptide
MRVMGIQRNYPQWWIWSMLGFWMLMICNGMWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNARRRVVEREKRAVGMGAVFLGFLGAAGSTMGAASITLTVQARQLLSGIVQQQSNLLKAIEAQQHMLKLTVWGIKQLQARVLALERYLKDQQLLGMWGCSGKLICTTNVYWNSSWSNKTYGDIWDNMTWMQWEREISNYTEIIYELLEESQNQQEKNEQDLLALDRWNSLWNWFNITNWLWYIKIFIMIVGGLIGLRIIFAVLSLVNRVRQGYSPLSLQTLIPSPRGPDRPGGIEEEGGEQDRNRSTRLVSGFLALVWDDLRSLCLFIYHRLRDFILIAARAGELLGRSSLKGLRRGWEALKYLGSLVQYWGLELKRSAISLLDTLAIAVGEGTDRILEFVLGICRAIRNIPTRIRQGFETALL

SEQ ID NO: 276 - protein, 651 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGSGLNDIFEAQKIEWHE

SEQ ID NO: 277 - DNA, 2550 bp, Artificial Sequence
  Description of Artificial Sequence: Synthetic polynucleotide
atgcccatgggcagcctgcagcccctggccaccctgtacctgctgggcatgctggtggctagcgtgctggccgccgagaacctgtgggtgaccgtctactatggcgtgcccgtctggaaggaagccaaaaccacactgttctgcgctagcgacgctaaggcatacgagaaaaaagtgcacaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgatcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccagtggttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcgggccatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggattgactaaagtgggcaagtctgtggaattggtttgacatatcaaactggctgtggtatataaaaatatttataatgatagtaggaggcttaataggattaagaatagtttttgctgtgctttctgtaatacatagagttaggcagggatactcacctttgtcgtttcagacccataccccaaacccaaggggactcgacaggcccgaaagaatcgaagaagaagatggagagcaagacagaggcagatcgacgcgattagtgagcggattcttagctcttgcctgggacgatctgaggagcctgtgcctcttctgctaccaccgattgagagacttcatcttgattgcagcgaggattgtggaacttctgggacacagcagtctcaaggggttgagactggggtgggaaggcctcaagtatctgtggaatctcctggcatattggggtcgggaactaaaaattagtgctattaatttgtttgataccatagcaatagcagtagctgagtggacagatagggttatagaaataggacaaagactttgtagagcttttctccacatacctagaagaatcagacagggcctcgaaagggctttgctataataa

SEQ ID NO: 278 - protein, 847 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDLKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 279 - DNA, 2553 bp, Artificial Sequence
  Description of Artificial Sequence: Synthetic polynucleotide
atgcccatgggcagcctgcagcccctggccaccctgtacctgctgggcatgctggtggctagcgtgctggccgccgagaacctgtgggtgaccgtctactatggcgtgcccgtctggaaggaagccaaaaccacactgttctgcgctagcgacgctaaggcatacgagaaaaaagtgcacaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgatcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccagtggttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcgggccatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggattgactaggcaagtgggcaagtctgtggaattggtttgacatatcaaactggctgtggtatataaaaatatttataatgatagtaggaggcttaataggattaagaatagtttttgctgtgctttctgtaatacatagagttaggcagggatactcacctttgtcgtttcagacccataccccaaacccaaggggactcgacaggcccgaaagaatcgaagaagaagatggagagcaagacagaggcagatcgacgcgattagtgagcggattcttagctcttgcctgggacgatctgaggagcctgtgcctcttctgctaccaccgattgagagacttcatcttgattgcagcgaggattgtggaacttctgggacacagcagtctcaaggggttgagactggggtgggaaggcctcaagtatctgtggaatctcctggcatattggggtcgggaactaaaaattagtgctattaatttgtttgataccatagcaatagcagtagctgagtggacagatagggttatagaaataggacaaagactttgtagagcttttctccacatacctagaagaatcagacagggcctcgaaagggctttgctataataa

SEQ ID NO: 280 - protein, 848 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDLGKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 281 - DNA, 2550 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaagaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggattgactaaagtgggcaagtctgtggaattggtttgacatatcaaactggctgtggtatataaaaatatttataatgatagtaggaggcttaataggattaagaatagtttttgctgtgctttctgtaatacatagagttaggcagggatactcacctttgtcgtttcagacccataccccaaacccaaggggactcgacaggcccgaaagaatcgaagaagaagatggagagcaagacagaggcagatcgacgcgattagtgagcggattcttagctcttgcctgggacgatctgaggagcctgtgcctcttctgctaccaccgattgagagacttcatcttgattgcagcgaggattgtggaacttctgggacacagcagtctcaaggggttgagactggggtgggaaggcctcaagtatctgtggaatctcctggcatattggggtcgggaactaaaaattagtgctattaatttgtttgataccatagcaatagcagtagctgagtggacagatagggttatagaaataggacaaagactttgtagagcttttctccacatacctagaagaatcagacagggcctcgaaagggctttgctataataa

SEQ ID NO: 282 - protein, 847 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDLKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 283 - DNA, 2553 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaagaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggattgactaggcaagtgggcaagtctgtggaattggtttgacatatcaaactggctgtggtatataaaaatatttataatgatagtaggaggcttaataggattaagaatagtttttgctgtgctttctgtaatacatagagttaggcagggatactcacctttgtcgtttcagacccataccccaaacccaaggggactcgacaggcccgaaagaatcgaagaagaagatggagagcaagacagaggcagatcgacgcgattagtgagcggattcttagctcttgcctgggacgatctgaggagcctgtgcctcttctgctaccaccgattgagagacttcatcttgattgcagcgaggattgtggaacttctgggacacagcagtctcaaggggttgagactggggtgggaaggcctcaagtatctgtggaatctcctggcatattggggtcgggaactaaaaattagtgctattaatttgtttgataccatagcaatagcagtagctgagtggacagatagggttatagaaataggacaaagactttgtagagcttttctccacatacctagaagaatcagacagggcctcgaaagggctttgctataataa

SEQ ID NO: 284 - protein, 848 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDLGKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 285 - protein, 847 aa, Artificial Sequence; identical to SEQ ID NO: 282
  Description of Artificial Sequence: Synthetic polypeptide

SEQ ID NO: 286 - protein, 847 aa, Artificial Sequence; identical to SEQ ID NO: 278
  Description of Artificial Sequence: Synthetic polypeptide

SEQ ID NO: 287 - protein, 848 aa, Artificial Sequence; identical to SEQ ID NO: 284
  Description of Artificial Sequence: Synthetic polypeptide

SEQ ID NO: 288 - protein, 848 aa, Artificial Sequence; identical to SEQ ID NO: 280
  Description of Artificial Sequence: Synthetic polypeptide

SEQ ID NO: 289 - DNA, 2583 bp, Artificial Sequence
  Description of Artificial Sequence: Synthetic polynucleotide
atgagagtgatggggatacagaggaattgtcagcacttattcagatggggaactatgatcttggggatgataataatctgtagtgcagcagaaaacttgtgggtcactgtctactatggggtacctgtgtggaaagacgcagagaccaccttattttgtgcatcagatgctaaagcatatgagacagaaaagcataatgtctgggctacacatgcctgtgtacccacagaccccaacccacaagaaatacatttggaaaatgtgactgaagagtttaacatgtggaaaaataacatggtagagcagatgcatacagatatcatcagtctatgggaccaaagcctaaagccatgtgtaaagttaacccctctctgcgttactctacagtgtaccaatgtcaccaataatatcactgatgacatgaggggagaattaaaaaactgctctttcaatatgaccacagagctaagggataagaaacagaaggtttattcacttttttatagactagatgtagtacaaattaacgagaatcaaggtaataggagtaataatagtaacaaggagtatagattaataaattgtaatacctcagccattacacaggcttgtccaaaggtatcctttgagccaattcccatacattattgtgccccagctggttttgcgatcctaaagtgtaaggataagaagttcaatggaacagggccatgcccaagtgtcagcacagtacaatgcacacatggaatcaagccagtagtatcaactcaactgctgttaaatggcagtctagcagaagaagaggtaatgattagatctgaaaatatcacaaacaatgccaaaaacatactagtacaatttaacacgcctgtgcaaattaattgtaccagacctaacaacaatacaaggaaaagtatacgtataggaccaggacaagcattctatgcaacaggggacataataggggatataagacaagcacattgtactgtcagtaaagcaacatggaatgaaactttgggaaaggtggtcaaacaattaagaaaacactttgggaacaacacaataataagatttgctaattcctcaggaggggatctagaagtcacaacacatagttttaattgtggaggagaatttttctattgtaacacatcaggcctgttcaatagcacttggattagcaataccagcgtgcaggggtcaaatagcacggggtcaaatgacagtataactctcccatgcagaataaagcaaattataaatatgtggcagagaataggacaagcaatgtatgcccctcccatccaaggagtaataagatgtgtatcaaacattacagggctaatattaacaagagatggtgggagtactaatagtacaactgaaaccttcagacctggaggaggagatatgagggacaattggagaagtgaattatataagtataaagtagtaaaaattgaaccactaggagtagcacccaccagggcaaagagaagagtggtggggagagaaaaaagagcagttggaataggagctgtcttccttgggttcttaggagcagcaggaagcactatgggcgcggcgtcaatgacgctgacggtacaggccagaaatttattatctggcatagtgcaacagcaaagcaatttgctgagggctatagaggctcaacaacatctgttgaaactcacggtctggggcattaaacagctccaggcaagggtcctggctgtggaaagatacctaagggatcaacagcttctaggaatttggggctgctctggaaaactcatctgcaccactaatgtgccctggaactctagttggagtaatagaaacctgagtgagatatgggacaacatgacctggctgcaatgggataaagaaattagcaattacacacagataatatatgggctacttgaagaatcgcagaaccagcaggaaaagaatgaacaagacttattggcattggataagtgggcaagtctgtggaattggtttgacatatcaaactggctgtggtatataaaaatatttataatgatagtaggaggcttaataggattaagaatagtttttgctgtgctttctgtaatacatagagttaggcagggatactcacctttgtcgtttcagacccataccccaaacccaaggggactcgacaggcccgaaagaatcgaagaagaagatggagagcaagacagaggcagatcgacgcgattagtgagcggattcttagctcttgcctgggacgatctgaggagcctgtgcctcttctgctaccaccgattgagagacttcatcttgattgcagcgaggattgtggaacttctgggacacagcagtctcaaggggttgagactggggtgggaaggcctcaagtatctgtggaatctcctggcatattggggtcgggaactaaaaattagtgctattaatttgtttgataccatagcaatagcagtagctgagtggacagatagggttatagaaataggacaaagactttgtagagcttttctccacatacctagaagaatcagacagggcctcgaaagggctttgctataa

SEQ ID NO: 290 - protein, 860 aa, Artificial Sequence
  Description of Artificial Sequence: Synthetic polypeptide
MRVMGIQRNCQHLFRWGTMILGMIIICSAAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGREKRAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 291 - DNA, 2570 bp, Artificial Sequence
  Description of Artificial Sequence: Synthetic polynucleotide
tctagaccaccatgcccatgggcagcctgcagcccctggccaccctgtacctgctgggcatgctggtggctagcgtgctggccgccgagaacctgtgggtgaccgtctactatggcgtgcccgtctggaaggaagccaaaaccacactgttctgcgctagcgacgctaaggcatacgagaaaaaagtgcacaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgatcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccagtggttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcgggccatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggattgactaggcaagtgggcaagtctgtggaattggtttgacatatcaaactggctgtggtatataaaaatatttataatgatagtaggaggcttaataggattaagaatagtttttgctgtgctttctgtaatacatagagttaggcagggatactcacctttgtcgtttcagacccataccccaaacccaaggggactcgacaggcccgaaagaatcgaagaagaagatggagagcaagacagaggcagatcgacgcgattagtgagcggattcttagctcttgcctgggacgatctgaggagcctgtgcctcttctgctaccaccgattgagagacttcatcttgattgcagcgaggattgtggaacttctgggacacagcagtctcaaggggttgagactggggtgggaaggcctcaagtatctgtggaatctcctggcatattggggtcgggaactaaaaattagtgctattaatttgtttgataccatagcaatagcagtagctgagtggacagatagggttatagaaataggacaaagactttgtagagcttttctccacatacctagaagaatcagacagggcctcgaaagggctttgctataataaggatcc

SEQ ID NO: 292 - protein, 848 aa, Artificial Sequence; identical to SEQ ID NO: 280
  Description of Artificial Sequence: Synthetic polypeptide

SEQ ID NO: 293 - DNA, 2567 bp, Artificial Sequence
  Description of Artificial Sequence: Synthetic polynucleotide
tctagaccaccatgcccatgggcagcctgcagcccctggccaccctgtacctgctgggcatgctggtggctagcgtgctggccgccgagaacctgtgggtgaccgtctactatggcgtgcccgtctggaaggaagccaaaaccacactgttctgcgctagcgacgctaaggcatacgagaaaaaagtgcacaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgatcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccagtggttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcgggccatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggattgactaaagtgggcaagtctgtggaattggtttgacatatcaaactggctgtggtatataaaaatatttataatgatagtaggaggcttaataggattaagaatagtttttgctgtgctttctgtaatacatagagttaggcagggatactcacctttgtcgtttcagacccataccccaaacccaaggggactcgacaggcccgaaagaatcgaagaagaagatggagagcaagacagaggcagatcgacgcgattagtgagcggattcttagctcttgcctgggacgatctgaggagcctgtgcctcttctgctaccaccgattgagagacttcatcttgattgcagcgaggattgtggaacttctgggacacagcagtctcaaggggttgagactggggtgggaaggcctcaagtatctgtggaatctcctggcatattggggtcgggaactaaaaattagtgctattaatttgtttgataccatagcaatagcagtagctgagtggacagatagggttatagaaataggacaaagactttgtagagcttttctccacatacctagaagaatcagacagggcctcgaaagggctttgctataataaggatcc

SEQ ID NO: 294 - protein, 847 aa, Artificial Sequence; identical to SEQ ID NO: 278
  Description of Artificial Sequence: Synthetic polypeptide

SEQ ID NO: 295 - protein, 848 aa, Artificial Sequence; identical to SEQ ID NO: 280
  Description of Artificial Sequence: Synthetic polypeptide

SEQ ID NO: 296 - protein, 847 aa, Artificial Sequence; identical to SEQ ID NO: 278
  Description of Artificial Sequence: Synthetic polypeptide

SEQ ID NO: 297 - DNA, 1962 bp, Artificial Sequence
  Description of Artificial Sequence: Synthetic polynucleotide
atgcccatgggcagcctgcagcccctggccaccctgtacctgctgggcatgctggtggctagcgtgctggccgccgagaacctgtgggtgaccgtctactatggcgtgcccgtctggaaggaagccaaaaccacactgttctgcgctagcgacgctaaggcatacgagaaaaaagtgcacaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgatcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccagtggttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcgggccatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggatctgcctagcaccggatgatga

SEQ ID NO: 298 - DNA, 1992 bp, Artificial Sequence
  Description of Artificial Sequence: Synthetic polynucleotide
atgcccatgggcagcctgcagcccctggccaccctgtacctgctgggcatgctggtggctagcgtgctggccggcgggggcgggggcggcgggggcgggggcggcgggggcgggggcgccgagaacctgtgggtgaccgtctactatggcgtgcccgtctggaaggaagccaaaaccacactgttctgcgctagcgacgctaaggcatacgagaaaaaagtgcacaatgtctgggctactcatgcatgcgtgcctaccgatccaaatccccaggagatggtgctgaagaacgtcacagaaaactttaatatgtggaagaacgacatggtggatcagatgcacgaggacgtgatcagcctgtgggatcagtccctgaagccatgcgtgaaactgactcccctgtgcgtcaccctgaactgtactaatgccaccgcttccaacagctccatcattgaggggatgaagaactgttctttcaatatcactaccgagctgcgcgacaagcgagaaaagaaaaatgccctgttttacaaactggacatcgtgcagctggatggcaactctagtcagtatagactgattaactgcaatacaagcgtgatcactcaggcatgtccaaaggtcagtttcgatcctattccaatccactactgcgcacccgccggatatgctatcctgaagtgtaacaacaagaccttcaccggcactgggccttgcaacaacgtgagcaccgtccagtgtacacatggcattaagccagtggtcagcacccagctgctgctgaacggcagcctggcagagggcgaaatcattatccgcagcgagaacatcacaaataatgtgaagactatcatcgtccacctgaacgagagcgtgaagattgaatgcacacggcccaacaacaagaccaggacatccattcgcatcggacctggccagtggttctacgctactggccaggtcatcggggacatcagagaggcctattgtaacatcaatgagtcaaagtggaatgaaactctgcagagggtgagcaagaaactgaaggaatacttccctcacaaaaacatcacctttcagccatcaagcggcggggacctggagattacaactcattctttcaattgcggaggcgaattcttttactgtaacacctcctctctgtttaatcgcacatatatggctaacagtactgatatggcaaactctactgagaccaatagtacacgaactattaccatccattgccggatcaagcagattatcaacatgtggcaggaagtggggcgggccatgtatgctccccctattgcaggaaatattacctgtatcagcaacattaccggcctgctgctgacaagagacgggggaaagaacaatacagagacttttaggcctggcgggggaaacatgaaagataattggcgctccgagctgtacaagtataaagtggtcaagatcgaaccactgggagtggcacctacccgatgtaaacggagagtggtcggaaggcgccgacggagaagggcagtgggaatcggagccgtcttcctgggctttctgggagcagctggcagcacaatgggagcagcctctatgaccctgacagtgcaggctcgaaatctgctgagtgggatcgtgcagcagcagtcaaacctgctgcgagcaccagaggcacagcagcatctgctgaagctgaccgtgtggggcatcaagcagctgcaggccagagtgctggctgtcgaacggtacctgagagatcagcagctgctgggaatctggggatgcagcggaaagctgatttgctgtacaaacgtgccctggaatagttcatggtcaaacaggaatctgagcgagatctgggacaatatgacctggctgcagtgggataaggaaatcagtaactacacacagatcatctatggcctgctggaggaatcacagaaccagcaggagaaaaatgaacaggacctgctggccctggattgatga

SEQ ID NO: 299 - DNA, 1989 bp, Artificial Sequence
  Description of Artificial Sequence: Synthetic polynucleotide
atgcccatgggctccctgcagcccctggccaccctgtacctgctgggcatgctggtggcctccgtgctggccggcgggggcgggggcggcgggggcgggggcggcgggggcgggggcgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaagaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggactag

SEQ ID NO: 300 - protein, 662 aa, Artificial Sequence
  Description of Artificial Sequence: Synthetic polypeptide
MPMGSLQPLATLYLLGMLVASVLAGGGGGGGGGGGGGGGAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 301 - DNA, 1959 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaagaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggacctgcctagcaccggatag

SEQ ID NO: 302 - protein, 652 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDLPSTG

SEQ ID NO: 303 - protein, 7 aa, Artificial Sequence
  Description of Artificial Sequence: Synthetic peptide
  MOD_RES (3)..(3): Any amino acid
  MOD_RES (6)..(7): Any amino acid
LPXTGXX

SEQ ID NO: 304 - protein, 8 aa, Artificial Sequence
  Description of Artificial Sequence: Synthetic peptide
  MOD_RES (6)..(8): Any amino acid
GGGGGXXX

SEQ ID NO: 305 - protein, 12 aa, Artificial Sequence
  Description of Artificial Sequence: Synthetic peptide
  MOD_RES (3)..(3): Any amino acid
  MOD_RES (10)..(12): Any amino acid
LPXTGGGGGXXX

SEQ ID NO: 306 - protein, 10 aa, Artificial Sequence
  Description of Artificial Sequence: Synthetic peptide
  MOD_RES (1)..(3): Any amino acid
  MOD_RES (6)..(6): Any amino acid
  MOD_RES (9)..(10): Any amino acid
XXXLPXTGXX

SEQ ID NO: 307 - protein, 5 aa, Artificial Sequence
  Description of Artificial Sequence: Synthetic peptide
GGGGG

SEQ ID NO: 308 - protein, 12 aa, Artificial Sequence
  Description of Artificial Sequence: Synthetic peptide
  MOD_RES (1)..(3): Any amino acid
  MOD_RES (6)..(6): Any amino acid
XXXLPXTGGGGG

SEQ ID NO: 309 - protein, 5 aa, Artificial Sequence
  Description of Artificial Sequence: Synthetic peptide
GGGSG

SEQ ID NO: 310 - protein, 815 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGGSGDIIKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 311 - DNA, 2451 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaacaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggacggcggcggctccggcgacatcatcaagctgctgaacgagcaggtgaacaaggagatgaactcctccaacctgtacatgtccatgtcctcctggtgctacacccactccctggacggcgccggcctgttcctgttcgaccacgccgccgaggagtacgagcacgccaagaagctgatcatcttcctgaacgagaacaacgtgcccgtgcagctgacctccatctccgcccccgagcacaagttcgagggcctgacccagatcttccagaaggcctacgagcacgagcagcacatctccgagtccatcaacaacatcgtggaccacgccatcaagtccaaggaccacgccaccttcaacttcctgcagtggtacgtggccgagcagcacgaggaggaggtgctgttcaaggacatcctggacaagatcgagctgatcggcaacgagaaccacggcctgtacctggccgaccagtacgtgaagggcatcgccaagtcccgcaagtcctgataa

SEQ ID NO: 312 - protein, 815 aa, Artificial Sequence
  Description of Artificial Sequence: Synthetic polypeptide
MPMGSLQPLATLYLLGMLVASVLAAENLWVTVYYGVPVWKEAKTTLFCASDAKAYEKKVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITKNVKTIIVHLNESVKIECTRPNNKTRTSIRIGPGQWFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGGSGDIIKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 313 - DNA, 2451 bp, Artificial Sequence
  Description of Artificial Sequence: Synthetic polynucleotide
atgcccatgggctccctgcagcccctggccaccctgtacctgctgggcatgctggtggcctccgtgctggccgccgagaacctgtgggtgaccgtgtactacggcgtgcccgtgtggaaggaggccaagaccaccctgttctgcgcctccgacgccaaggcctacgagaagaaggtgcacaacgtgtgggccacccacgcctgcgtgcccaccgaccccaacccccaggagatggtgctgaagaacgtgaccgagaacttcaacatgtggaagaacgacatggtggaccagatgcacgaggacgtgatctccctgtgggaccagtccctgaagccctgcgtgaagctgacccccctgtgcgtgaccctgaactgcaccaacgccaccgcctccaactcctccatcatcgagggcatgaagaactgctccttcaacatcaccaccgagctgcgcgacaagcgcgagaagaagaacgccctgttctacaagctggacatcgtgcagctggacggcaactcctcccagtaccgcctgatcaactgcaacacctccgtgatcacccaggcctgccccaaggtgtccttcgaccccatccccatccactactgcgcccccgccggctacgccatcctgaagtgcaacaacaagaccttcaccggcaccggcccctgcaacaacgtgtccaccgtgcagtgcacccacggcatcaagcccgtggtgtccacccagctgctgctgaacggctccctggccgagggcgagatcatcatccgctccgagaacatcaccaagaacgtgaagaccatcatcgtgcacctgaacgagtccgtgaagatcgagtgcacccgccccaacaacaagacccgcacctccatccgcatcggccccggccagtggttctacgccaccggccaggtgatcggcgacatccgcgaggcctactgcaacatcaacgagtccaagtggaacgagaccctgcagcgcgtgtccaagaagctgaaggagtacttcccccacaagaacatcaccttccagccctcctccggcggcgacctggagatcaccacccactccttcaactgcggcggcgagttcttctactgcaacacctcctccctgttcaaccgcacctacatggccaactccaccgacatggccaactccaccgagaccaactccacccgcaccatcaccatccactgccgcatcaagcagatcatcaacatgtggcaggaggtgggccgcgccatgtacgccccccccatcgccggcaacatcacctgcatctccaacatcaccggcctgctgctgacccgcgacggcggcaagaacaacaccgagaccttccgccccggcggcggcaacatgaaggacaactggcgctccgagctgtacaagtacaaggtggtgaagatcgagcccctgggcgtggcccccacccgctgcaagcgccgcgtggtgggccgccgccgccgccgccgcgccgtgggcatcggcgccgtgttcctgggcttcctgggcgccgccggctccaccatgggcgccgcctccatgaccctgaccgtgcaggcccgcaacctgctgtccggcatcgtgcagcagcagtccaacctgctgcgcgcccccgaggcccagcagcacctgctgaagctgaccgtgtggggcatcaagcagctgcaggcccgcgtgctggccgtggagcgctacctgcgcgaccagcagctgctgggcatctggggctgctccggcaagctgatctgctgcaccaacgtgccctggaactcctcctggtccaaccgcaacctgtccgagatctgggacaacatgacctggctgcagtgggacaaggagatctccaactacacccagatcatctacggcctgctggaggagtcccagaaccagcaggagaagaacgagcaggacctgctggccctggacggcggcggctccggcgacatcatcaagctgctgaacgagcaggtgaacaaggagatgaactcctccaacctgtacatgtccatgtcctcctggtgctacacccactccctggacggcgccggcctgttcctgttcgaccacgccgccgaggagtacgagcacgccaagaagctgatcatcttcctgaacgagaacaacgtgcccgtgcagctgacctccatctccgcccccgagcacaagttcgagggcctgacccagatcttccagaaggcctacgagcacgagcagcacatctccgagtccatcaacaacatcgtggaccacgccatcaagtccaaggaccacgccaccttcaacttcctgcagtggtacgtggccgagcagcacgaggaggaggtgctgttcaaggacatcctggacaagatcgagctgatcggcaacgagaaccacggcctgtacctggccgaccagtacgtgaagggcatcgccaagtcccgcaagtcctagtaa

SEQ ID NO: 314 - protein, 96 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYC

SEQ ID NO: 315 - protein, 96 aa, Artificial Sequence
  Description of Artificial Sequence: Synthetic polypeptide
QVQLVQSGAEVKKPGASVTVSCQASGYTFTNYYVHWVRQAPGQGLQLMGWIDPSWGRTNYAQNFQGRITMTRDTSTSTVYMEMRSLRSEDTAVYYC

SEQ ID NO: 316 - protein, 96 aa, Artificial Sequence
  Description of Artificial Sequence: Synthetic polypeptide
QVRLLQYGGGVKRPGASMTISCVASGYNFNDYYIHWVRQAPGQGLELMGWIDPSGGRTDYAGAFGDRVSMYRDKSMNTLYMDLRSLRSGDTAMYYC

SEQ ID NO: 317 - protein, 96 aa, Artificial Sequence
  Description of Artificial Sequence: Synthetic polypeptide
QVRLAQYGGGVKRLGATMTLSCVASGYTFNDYYIHWVRQAPGQGFELLGYIDPANGRPDYAGALRERLSFYRDKSMETLYMDLRSLRYDDTAMYYC

SEQ ID NO: 318 - protein, 96 aa, Artificial Sequence
  Description of Artificial Sequence: Synthetic polypeptide
QVQLEQSGTAVRKPGASVTLSCQASGYNFVKYIIHWVRQKPGLGFEWVGMIDPYRGRPWSAHKFQGRLSLSRDTSMEILYMTLTSLKSDDTATYFC

SEQ ID NO: 319 - protein, 95 aa, Artificial Sequence
  Description of Artificial Sequence: Synthetic polypeptide
QGQLVQSGGGLKKPGTSVTISCLASEYTFNEFVIHWIRQAPGQGPLWLGLIKRSGRLMTAYNFQDRLSLRRDRSTGTVFMELRGLRPDDTAVYYC

SEQ ID NO: 320 - protein, 96 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYC

SEQ ID NO: 321 - protein, 96 aa, Artificial Sequence
  Description of Artificial Sequence: Synthetic polypeptide
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFC

SEQ ID NO: 322 - protein, 105 aa, Artificial Sequence
  Description of Artificial Sequence: Synthetic polypeptide
QVQLVQSGAAVRKPGASVTVSCKFAEDDDYSPYWVNPAPEHFIHFLRQAPGQQLEWLAWMNPTNGAVNYAWYLNGRVTATRDRSMTTAFLEVKSLRSDDTAVYYC

SEQ ID NO: 323 - protein, 98 aa, Artificial Sequence
  Description of Artificial Sequence: Synthetic polypeptide
QVQLVQSGSGVKKPGASVRVSCWTSEDIFERTELIHWVRQAPGQGLEWIGWVKTVTGAVNFGSPDFRQRVSLTRDRDLFTAHMDIRGLTQGDTATYFC

SEQ ID NO: 324 - protein, 98 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR

SEQ ID NO: 325 - protein, 98 aa, Homo sapiens; identical to SEQ ID NO: 324

SEQ ID NO: 326 - protein, 63 aa, Artificial Sequence
  Description of Artificial Sequence: Synthetic polypeptide
WVRQAPGQGLEWMGMINPSGGSTSYAQKFQGRVTMTRDTSTSTVYMYLSSLRSEDTAVYYCVR

SEQ ID NO: 327 - protein, 63 aa, Artificial Sequence
  Description of Artificial Sequence: Synthetic polypeptide
WVRQAPGQGLEWMGMINPSGGRTSYPYKFQGRVTMTRDTSTSTVYMEVSSLRSEDTAVYYCVR

SEQ ID NO: 328 - protein, 63 aa, Artificial Sequence
  Description of Artificial Sequence: Synthetic polypeptide
WVRQAPGQGLEWMGMIDPSGGRTSYAQKFQGRVTMTRDTSTSTVYMELSSLRSEDTAVHYCAR

SEQ ID NO: 329 - protein, 63 aa, Artificial Sequence
  Description of Artificial Sequence: Synthetic polypeptide
WVRQAPGQGLEWMGMIDPSVGRTTYAEKFQGRVTMTRDTSTSTVYMDLSSLRSEHTAVYYCAR

SEQ ID NO: 330 - protein, 63 aa, Artificial Sequence
  Description of Artificial Sequence: Synthetic polypeptide
WVRQAPGQGLEWMGMIDPSVGRTTYAEKFQGRVTMTRDTSTSTVYMDLSSLRSEDTAVYYCAR

SEQ ID NO: 331 - protein, 63 aa, Artificial Sequence; identical to SEQ ID NO: 330
  Description of Artificial Sequence: Synthetic polypeptide

SEQ ID NO: 332 - protein, 63 aa, Artificial Sequence
  Description of Artificial Sequence: Synthetic polypeptide
WVRQAPGQGLEWMGMINPRGGSTTYAQRFQGRVTMTRDTSTSIVYMELSRLRSEDTAVYYCVR

SEQ ID NO: 333 - protein, 63 aa, Artificial Sequence
  Description of Artificial Sequence: Synthetic polypeptide
WVRQAPGQGLEWMGMINPSGGRTSSPYKFQGRLTMTRDTSTSTVYMDLSSLRPDDTAVYYCVR

SEQ ID NO: 334 - protein, 63 aa, Artificial Sequence
  Description of Artificial Sequence: Synthetic polypeptide
WVRQAPGQGLEWMGMVNPSGGRTSYPHKFQGRVTMTRDTSTSTVYMGLSSLRSEDTAVYYCAR

SEQ ID NO: 335 - protein, 63 aa, Artificial Sequence
  Description of Artificial Sequence: Synthetic polypeptide
WVRQAPGAGLEWMGMINPSGGRTTYPQKFQGRVTMTRDTSTSTVHMKLSSLRSQDTAVYYCAR

SEQ ID NO: 336 - protein, 63 aa, Artificial Sequence
  Description of Artificial Sequence: Synthetic polypeptide
WVRQAPGAGLEWMGMINPSGGRTTYPQKFQGRVTMTRDTSTSTVYMKLSSLRSQDTAVYYCAR

SEQ ID NO: 337 - protein, 63 aa, Artificial Sequence; identical to SEQ ID NO: 336
  Description of Artificial Sequence: Synthetic polypeptide

SEQ ID NO: 338 - protein, 63 aa, Artificial Sequence
  Description of Artificial Sequence: Synthetic polypeptide
WVRQAPGQGLEWMGMIDPSGGRTSYAPKFQGRLTMTRDTSTDTLYMQLNSLRSEDTAVYYCAR

SEQ ID NO: 339 - protein, 63 aa, Artificial Sequence
  Description of Artificial Sequence: Synthetic polypeptide
WVRQAPGQGLEWMGMIDPSYGRTSYAQKFQGRVTMTRDTSTSTVYMELSSLRSEDTAVFYCAR

SEQ ID NO: 340 - protein, 63 aa, Artificial Sequence; identical to SEQ ID NO: 339
  Description of Artificial Sequence: Synthetic polypeptide

SEQ ID NO: 341 - protein, 63 aa, Artificial Sequence; identical to SEQ ID NO: 330
  Description of Artificial Sequence: Synthetic polypeptide

SEQ ID NO: 342 - protein, 63 aa, Artificial Sequence
  Description of Artificial Sequence: Synthetic polypeptide
WVRQAPGQGLEWMGMLDPSGGRTSYPQKFQGRVTMTRDTSTSTVYMYLSSLRSEDTAVYYCVR

SEQ ID NO: 343 - protein, 63 aa, Artificial Sequence
  Description of Artificial Sequence: Synthetic polypeptide
WVRQAPGQRLEWMGLINPSGGRTSYPHQFQGRVTMTRDTSTSTVYMYLSSLRAEDTAVYYCVR

SEQ ID NO: 344 - protein, 63 aa, Artificial Sequence
  Description of Artificial Sequence: Synthetic polypeptide
WVRQAPGQGLEWMGMLDPSGGRTSHPHKFQGRVTLTRDTSTSTVYMYLSSLRSEDTAVYYCVR

SEQ ID NO: 345 - protein, 63 aa, Artificial Sequence; identical to SEQ ID NO: 333
  Description of Artificial Sequence: Synthetic polypeptide

SEQ ID NO: 346 - protein, 63 aa, Artificial Sequence
  Description of Artificial Sequence: Synthetic polypeptide
WVRQAPGQGLEWMGMIDPSGGRPSYAQKFQGRVSMTRDTSTSTVYMELSSLRSEDTALYYCVR

SEQ ID NO: 347 - protein, 63 aa, Artificial Sequence; identical to SEQ ID NO: 338
  Description of Artificial Sequence: Synthetic polypeptide

SEQ ID NO: 348 - protein, 63 aa, Artificial Sequence
  Description of Artificial Sequence: Synthetic polypeptide
WVRQAPGQGLKWVGMLDPSGGRTTLAHTFQGRVTMTRDTSTSTVYMELNSLRSEDTAVYYCAR

SEQ ID NO: 349 - protein, 58 aa, Artificial Sequence
  Description of Artificial Sequence: Synthetic polypeptide
PGQGLKWVGMLDPSGGRTTLAHTFQGRVTMTRDTSTSTVYMELNSLRSEDTAVYYCAR

SEQ ID NO: 350 - protein, 63 aa, Artificial Sequence; identical to SEQ ID NO: 348
  Description of Artificial Sequence: Synthetic polypeptide

SEQ ID NO: 351 - protein, 63 aa, Artificial Sequence
  Description of Artificial Sequence: Synthetic polypeptide
WVRQAPGQGLEWVGMIDPSVGRTTLPHKFQGRVTMTRDTSTSTVYMKLSTLRSEDTAVYFCAR

SEQ ID NO: 352 - protein, 62 aa, Artificial Sequence
  Description of Artificial Sequence: Synthetic polypeptide
VRQAPGQRLELMGMIDPSRGRTDYAQKFQGRVTMSRDTSTSTLYMELRSLRPDDTALYYCVR

SEQ ID NO: 353 - protein, 63 aa, Artificial Sequence
  Description of Artificial Sequence: Synthetic polypeptide
WVRQAPGQGLDSMGWIDPSVGRTSYSYKFRDRISMFRDTSTNTVYMELRSLRSDDTAVYYCVR

SEQ ID NO: 354 - protein, 63 aa, Artificial Sequence
  Description of Artificial Sequence: Synthetic polypeptide
WVRQAPGQRLEWMGMIDPSVGRPTVAGNFQGRVTLTRDRSTDTVYMDLSSLRSEDTAVYYCAR

SEQ ID NO: 355 - protein, 63 aa, Artificial Sequence
  Description of Artificial Sequence: Synthetic polypeptide
WVRQAPGQGLEWMGMIDPSVGRPTRAGKFQGRVTMTRDRSTSTVYMDLSSLRSEDTAMYYCAR

SEQ ID NO: 356 - protein, 63 aa, Artificial Sequence
  Description of Artificial Sequence: Synthetic polypeptide
WVRQAPGQGLEWMGMIDPSVGRPTRAGKFQGRVTMTRDRSTSTVYMDLSSLKSEDTAVYYCAR

SEQ ID NO: 357 - protein, 63 aa, Artificial Sequence
  Description of Artificial Sequence: Synthetic polypeptide
WVRQAPGQGPEWMGMIDPSFGRPTRPGRFQDRVTLTRDKSTSTVYMDLSSLRPEDTAVYYCAR

SEQ ID NO: 358 - protein, 63 aa, Artificial Sequence
  Description of Artificial Sequence: Synthetic polypeptide
WVRQAPGQRLEWMGMIDPSVGRPSRPYKFQDRVTMTRDRFTNTVYMDLSSLRSEDTAVYYCAR

SEQ ID NO: 359 - protein, 63 aa, Artificial Sequence
  Description of Artificial Sequence: Synthetic polypeptide
WVRQAPGQGFECMGMLDPSGGRTDYSHKFQGRVTMTRDTSTSTVYMSLRSLKSEDTAVYYCVR

SEQ ID NO: 360 - protein, 63 aa, Artificial Sequence; identical to SEQ ID NO: 359
  Description of Artificial Sequence: Synthetic polypeptide

SEQ ID NO: 361 - protein, 63 aa, Artificial Sequence; identical to SEQ ID NO: 359
  Description of Artificial Sequence: Synthetic polypeptide

SEQ ID NO: 362 - protein, 98 aa, Artificial Sequence
  Description of Artificial Sequence: Synthetic polypeptide
QVQLVQSGAEVKKPGASVTVSCQASGYTFTNYYVHWVRQAPGQGLQLMGWIDPSWGRTNYAQNFQGRITMTRDTSTSTVYMEMRSLRSEDTAVYYCAR

SEQ ID NO: 363 - protein, 63 aa, Artificial Sequence
  Description of Artificial Sequence: Synthetic polypeptide
WVRQAPGQRLELMGMIDPSRGRTDYAQKFQGRVTMSRDTSTSTLYMELRSLRPDDTALYYCVR

SEQ ID NO: 364 - protein, 63 aa, Artificial Sequence
  Description of Artificial Sequence: Synthetic polypeptide
WVRQAPGQGLECMGWIDPSVGRINYAQKFQGRVTMTRDRSTSTVYMGLSSLRSEDTAIYYCVR

SEQ ID NO: 365 - protein, 63 aa, Artificial Sequence
  Description of Artificial Sequence: Synthetic polypeptide
WVRQAPGQGLECMGWIDPSVGRISYGQKFQGRVTMTRDRSTSTVYMGLSSLRSEDTAMYYCVR

SEQ ID NO: 366 - protein, 64 aa, Artificial Sequence
  Description of Artificial Sequence: Synthetic polypeptide
WVRQAPGQGPEWMGMIDPSVGRPTTAQGKFQGRVTMTRDRYTSTAYMDLSSLRSEDTAVYYCAR

SEQ ID NO: 367 - protein, 63 aa, Artificial Sequence
  Description of Artificial Sequence: Synthetic polypeptide
WVRQAPGQGLELMGWIDPSVGRINYGQKFEGRVTMTRDRSTSTVYMGLSSLKSEDTAVYYCVR

SEQ ID NO: 368 - protein, 63 aa, Artificial Sequence
  Description of Artificial Sequence: Synthetic polypeptide
WVRQAPGQGLELMGWIDPSVGRINYGQKFQGRVTMTRDRSTSTVYMGLSSLRSEDTAIYYCVR

SEQ ID NO: 369 - protein, 63 aa, Artificial Sequence; identical to SEQ ID NO: 368
  Description of Artificial Sequence: Synthetic polypeptide

SEQ ID NO: 370 - protein, 63 aa, Artificial Sequence
  Description of Artificial Sequence: Synthetic polypeptide
WVRQAPGQRLELMGWIDPYRGRTDYAQKFQDRVSMYRDTSTNTLYMDLRSLRPDDTALYYCVR

SEQ ID NO: 371 - protein, 63 aa, Artificial Sequence
  Description of Artificial Sequence: Synthetic polypeptide
WVRQAPGQGLELMGWIDPSGGRTDYSQAFQGRISMFRDTSTSTVYMELRSLRSGDTAMYYCVR

SEQ ID NO: 372 - protein, 63 aa, Artificial Sequence
  Description of Artificial Sequence: Synthetic polypeptide
WVRQAPGQALEWLGMIDPRFGRPTRPQKFQGRVTLTRDTYTTTVYMSLSSLTPEDTAVYYCAR

SEQ ID NO: 373 - protein, 63 aa, Artificial Sequence
  Description of Artificial Sequence: Synthetic polypeptide
WVRQAPGQGLELMGWINPRGGRTDYSYRFEDRVSMYRDTSMSIVYMDLRNLKSADTAVYYCVR

SEQ ID NO: 374 - protein, 63 aa, Artificial Sequence
  Description of Artificial Sequence: Synthetic polypeptide
WVRQAPGQGPEWMGMVDPRFGRPTYAQKFQGRVAMTRDIYTSTVYMDLRSLKSEDTAIYFCVR

SEQ ID NO: 375 - protein, 63 aa, Artificial Sequence
  Description of Artificial Sequence: Synthetic polypeptide
WVRQAPGQGLELMGWIDPSGGRTDYAGAFGDRVSMYRDKSMNTLYMDLRSLRSGDTAMYYCVR

SEQ ID NO: 376 - protein, 98 aa, Artificial Sequence
  Description of Artificial Sequence: Synthetic polypeptide
QVQLVQSGATVKKPRASVTLSCRTSGYNFIDYFIHWVRRAPGQRLEVMGYIDPSRGRPDYAPNFRDRVSLYRDTSMSIVYLDLRDLTPDDTAIYYCVR

SEQ ID NO: 377 - protein, 98 aa, Artificial Sequence
  Description of Artificial Sequence: Synthetic polypeptide
QVQLVQSGGTVKSPGTSVTLSCKTSGYNFIDYYIHWVRRAPGQRPELMGYIDPSHGRPDYEGKFRDRISLYRDTSTSVVYMDVRGLRLDDTALYYCVR

SEQ ID NO: 378 - protein, 98 aa, Artificial Sequence
  Description of Artificial Sequence: Synthetic polypeptide
QVRLAQYGGGVKRLGATMTLSCVASGYTFNDYYIHWVRQAPGQGFELLGYIDPANGRPDYAGALRERLSFYRDKSMETLYMDLRSLRYDDTAMYYCVR

SEQ ID NO: 379 - protein, 98 aa, Artificial Sequence
  Description of Artificial Sequence: Synthetic polypeptide
QVQLVQSGGGVKRPGSTTTISCVASGYSFNDYYIHWVRQAPGQGLEVLGFIDPSNGRTNYAGAFGDRFSMYRDKSMETLYMDLRNLRSDDTAMYYCVR

SEQ ID NO: 380 - protein, 98 aa, Artificial Sequence
  Description of Artificial Sequence: Synthetic polypeptide
QVQLEQSGTAVRKPGASVTLSCQASGYNFVKYIIHWVRQKPGLGFEWVGMIDPYRGRPWSAHKFQGRLSLSRDTSMEILYMTLTSLKSDDTATYFCAR

SEQ ID NO: 381 - protein, 97 aa, Artificial Sequence
  Description of Artificial Sequence: Synthetic polypeptide
QGQLVQSGGGLKKPGTSVTISCLASEYTFNEFVIHWIRQAPGQGPLWLGLIKRSGRLMTAYNFQDRLSLRRDRSTGTVFMELRGLRPDDTAVYYCAR

SEQ ID NO: 382 - protein, 98 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAR

SEQ ID NO: 383 - protein, 98 aa, Artificial Sequence
  Description of Artificial Sequence: Synthetic polypeptide
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTR

SEQ ID NO: 384 - protein, 107 aa, Artificial Sequence
  Description of Artificial Sequence: Synthetic polypeptide
QVQLVQSGAAVRKPGASVTVSCKFAEDDDYSPYWVNPAPEHFIHFLRQAPGQQLEWLAWMNPTNGAVNYAWYLNGRVTATRDRSMTTAFLEVKSLRSDDTAVYYCAR

SEQ ID NO: 385 - protein, 100 aa, Artificial Sequence
  Description of Artificial Sequence: Synthetic polypeptide
QVQLVQSGSGVKKPGASVRVSCWTSEDIFERTELIHWVRQAPGQGLEWIGWVKTVTGAVNFGSPDFRQRVSLTRDRDLFTAHMDIRGLTQGDTATYFCAR

SEQ ID NO: 386 - protein, 98 aa, Homo sapiens; identical to SEQ ID NO: 324

SEQ ID NO: 387 - protein, 97 aa, Artificial Sequence; identical to SEQ ID NO: 381
  Description of Artificial Sequence: Synthetic polypeptide

SEQ ID NO: 388 - protein, 98 aa, Artificial Sequence; identical to SEQ ID NO: 362
  Description of Artificial Sequence: Synthetic polypeptide

SEQ ID NO: 389 - protein, 122 aa, Artificial Sequence
  Description of Artificial Sequence: Synthetic polypeptide
QVQLVQSGAAVKRPGASVTISCRASGYTFTTYYIHWVRQAPGQRLELMGMIDPSRGRTDYAQKFQGRVTMSRDTSTSTLYMELRSLRPDDTALYYCVRNVGTEGSLLHYDYWGQGTLVTVSS

SEQ ID NO: 390 - protein, 122 aa, Artificial Sequence
  Description of Artificial Sequence: Synthetic polypeptide
QVRLLQYGGGVKRPGASMTISCVASGYNFNDYYIHWVRQAPGQGLELMGWIDPSGGRTDYAGAFGDRVSMYRDKSMNTLYMDLRSLRSGDTAMYYCVRNVGTAGSLLHYDHWGLGVMVTVSS

SEQ ID NO: 391 - protein, 122 aa, Artificial Sequence
  Description of Artificial Sequence: Synthetic polypeptide
QVRLAQYGGGVKRLGATMTLSCVASGYTFNDYYIHWVRQAPGQGFELLGYIDPANGRPDYAGALRERLSFYRDKSMETLYMDLRSLRYDDTAMYYCVRNVGTAGSLLHYDHWGSGSPVIVSS

SEQ ID NO: 392 - protein, 122 aa, Artificial Sequence
  Description of Artificial Sequence: Synthetic polypeptide
QVQLVQSGGGVKRPGSTTTISCVASGYSFNDYYIHWVRQAPGQGLEVLGFIDPSNGRTNYAGAFGDRFSMYRDKSMETLYMDLRNLRSDDTAMYYCVRNVGTAGSLLHYDHWGTGSKIIVSS

SEQ ID NO: 393 - protein, 122 aa, Artificial Sequence
  Description of Artificial Sequence: Synthetic polypeptide
QVQLVQSGATVKKPRASVTLSCRTSGYNFIDYFIHWVRRAPGQRLEVMGYIDPSRGRPDYAPNFRDRVSLYRDTSMSIVYLDLRDLTPDDTAIYYCVRSEGTEGTVLHYDHWGPGTRVTVSP

SEQ ID NO: 394 - protein, 122 aa, Artificial Sequence
  Description of Artificial Sequence: Synthetic polypeptide
QVQLVQSGGTVKSPGTSVTLSCKTSGYNFIDYYIHWVRRAPGQRPELMGYIDPSHGRPDYEGKFRDRISLYRDTSTSVVYMDVRGLRLDDTALYYCVRGGGVEVSSNHYDHWGPGTMVFVSP

SEQ ID NO: 395 - protein, 122 aa, Artificial Sequence
  Description of Artificial Sequence: Synthetic polypeptide
QVQLVQSGAAVKRPGASVTISCRASGYTFTTYYIHWVRQAPGQGLELMGWINPRGGRTDYSYRFEDRVSMYRDTSMSIVYMDLRNLKSADTAVYYCVRNVGTSGSLLHYDFWGQGSLVTVSS

SEQ ID NO: 396 - protein, 5 aa, Artificial Sequence
  Description of Artificial Sequence: Synthetic peptide
  MOD_RES (3)..(3): Any amino acid
LPXTG

What is claimed is:

1. A recombinant HIV-1 envelope polypeptide comprising all the consecutive amino acids after the signal peptide in HIV-1 envelope CH505TFchim.6R.SOSIP.664v4.1 (SEQ ID NO:260), CH505M5chim.6R.SOSIP.664v4.1 (SEQ ID NO:242), CH505M11chim.6R.SOSIP.664v4.1 (SEQ ID NO:244), CH505w20.14chim.6R.SOSIP.664v4.1 (SEQ ID NO:254), CH505w30.20.chim.6R.SOSIP.664v4.1 (SEQ ID NO:258), CH505w30.12chim.6R.SOSIP.664v4.1 (SEQ ID NO:256), or CH505w136.B18chim.6R.SOSIP.664v4.1 (SEQ ID NO:252).

2. A recombinant trimer comprising three identical polypeptides of claim 1.

3. An immunogenic composition comprising the recombinant trimer of claim 2 and a carrier.

4. The composition of claim 3 further comprising an adjuvant.

5. The recombinant trimer of claim 2 comprising three polypeptides, each polypeptide comprising all the consecutive amino acids after the signal peptide in HIV-1 envelope CH505TFchim.6R.SOSIP644v4.1 (SEQ ID NO:260).

6. An immunogenic composition comprising the recombinant trimer of claim 5 and a carrier.

7. The immunogenic composition of claim 6 further comprising an adjuvant.

8. The recombinant trimer of claim 5, wherein the trimer is comprised in a nanoparticle.

9. The recombinant trimer of claim 2, wherein the trimer is comprised in a nanoparticle.

10. A method of inducing an immune response in a subject comprising administering a composition comprising a recombinant HIV-1 envelope polypeptide comprising all the consecutive amino acids after the signal peptide in HIV-1 envelope CH505TFchim.6R.SOSIP.664v4.1 (SEQ ID NO:260), CH505M5chim.6R.SOSIP.664v4.1 (SEQ ID NO:242), CH505M11chim.6R.SOSIP.664v4.1 (SEQ ID NO:244), CH505w20.14chim.6R.SOSIP.664v4.1 (SEQ ID NO:254), CH505w30.20.chim.6R.SOSIP.664v4.1 (SEQ ID NO:258), CH505w30.12chim.6R.SOSIP.664v4.1 (SEQ ID NO:256), or CH505w136.B18chim.6R.SOSIP.664v4.1 (SEQ ID NO:252).

11. The method of 10, wherein the composition comprises a recombinant trimer comprising three identical polypeptides of claim 10.

12. The method of claim 11, comprising administering HIV-1 polypeptides CH505TFchim.6R.SOSIP.664v4.1 (SEQ ID NO:260) as the recombinant trimer.

13. The method of claim 12, wherein the CH505TFchim.6R.SOSIP.664v4.1 (SEQ ID NO:260) recombinant trimer is administered as a nanoparticle.

14. The method of claim 10, wherein the composition further comprises a carrier.

15. The method of claim 14, further comprising administering an adjuvant.

16. The method of claim 10, further comprising administering a nucleic acid encoding CH5050TFchim.6R.SOSIP.664v4.1 (SEQ ID NO:260).

* * * * *